US008017370B2

(12) United States Patent
Spangenberg et al.

(10) Patent No.: US 8,017,370 B2
(45) Date of Patent: Sep. 13, 2011

(54) MANIPULATION OF ORGANIC ACID BIOSYNTHESIS AND SECRETION

(75) Inventors: German Spangenberg, Bundoora (AU); Michael Emmerling, Greensborough (AU); Eng Kok Ong, Vermont South (AU); Ramiro Mendez, Kingsbury (AU); Stephen Panter, Bundoora (AU); Marcel Labandera, Macleod (AU)

(73) Assignee: Agriculture Victoria Services Pty Ltd, Attwood (AU)

( * ) Notice: Subject to any disclaimer, the term of this patent is extended or adjusted under 35 U.S.C. 154(b) by 832 days.

(21) Appl. No.: 10/553,507

(22) PCT Filed: Apr. 14, 2004

(86) PCT No.: PCT/AU2004/000493
§ 371 (c)(1),
(2), (4) Date: Oct. 10, 2006

(87) PCT Pub. No.: WO2004/089066
PCT Pub. Date: Oct. 21, 2004

(65) Prior Publication Data
US 2007/0169212 A1  Jul. 19, 2007

(30) Foreign Application Priority Data

Apr. 14, 2003  (AU) ................................. 2003901796
Mar. 10, 2004  (AU) ................................. 2004901259

(51) Int. Cl.
*C12N 9/04* (2006.01)
*C12N 1/20* (2006.01)
*C12N 15/00* (2006.01)
*C12N 5/00* (2006.01)
*C12Q 1/00* (2006.01)
*C12Q 1/68* (2006.01)
*C12P 21/04* (2006.01)
*C07H 21/04* (2006.01)

(52) U.S. Cl. .............. 435/190; 435/4; 435/6; 435/69.1; 435/71.1; 435/252.3; 435/320.1; 435/440; 435/410; 536/23.2

(58) Field of Classification Search .................. None
See application file for complete search history.

(56) References Cited

U.S. PATENT DOCUMENTS
2004/0116682 A1  6/2004  Cheikh et al.

FOREIGN PATENT DOCUMENTS
EP           1033405 A2    9/2000
EP           1 122 316     8/2001
WO           WO 00/73475   12/2000

OTHER PUBLICATIONS

Branden et al. Introduction to Protein Structure, Garland Publishing Inc., New York, p. 247, 1991.*
Ellison et al. ucleotide sequence of a white clover alcohol dehydrogenase cDNA. Nucleic Acids Res. Aug. 25, 1990;18(16):4913.*
Brenda Database EC 1.1.1.37 Malate Dehydrognease. retrieved from the internet on May, 20, 2010 via http://www.brenda-enzymes.info/php/result_flat.php4?ecno=1.1.1.37.*
Beaujean et al., Integration and expression of Sorghum C4 phosphoenolpyruvate carboxylase and chloroplastic NADP+-malate dehydrogenase . . . , Plant Science, 2001, pp. 1199-1210, vol. 160, Publisher: Elsevier Science Ireland Ltd.
Gallardo et al., Monocotyledonous C4 NADP+-malate dehydrogenase is effeciently synthesized, targeted to cholorplasts and processed to an, Planta, 1995, pp. 324-332, vol. 197, Publisher: Springer-Verlag.
Hausler et al., Single and double overexpression of C4-cycle genes had differential effects on the pattern of endogenous enzymes, . . . , Journal of Experimental Botany, 2001, pp. 1785-1803, vol. 52, No. 362, Publisher: Society for Experimental Biology.
Hausler et al., Overexpression of C4-cycle enzymes in transgenic C3 plans: a biotechnological approach to improve C3-photosynthesis, Journal of Experimental Botany, Apr. 2002, pp. 591-607, vol. 53, No. 369, Publisher: Society for Experimental Biology.
Samac et al., Plant improvement for tolerance to aluminum in acid soils—a review, Plant Cell, Tissue and Organ Culture, 2003, pp. 189-207, vol. 78, Publisher: Kluwer Academic Publishers.
Tesfaye et al., Overexpression of malate dehydrogenase in transgenic alfalfa enhances organic acid synthesis and confers tolerance to . . . , Plant Physiology, Dec. 2001, pp. 1836-1844, vol. 127, Publisher: American Society of Plant Biologists.
Chen et al., Photosynthetic 14CO2 Fixation Products and Activities of Enzymes Related to Photosynthesis in Bermudagrass and Other Plants, Plant Physiol, 1971, pp. 199-203, vol. 47.
Genbank Accession AF346003, Lolium perenne malate dehydrogenase mRNA, partial cds, Apr. 3, 2001.

* cited by examiner

*Primary Examiner* — Yong D Pak
(74) *Attorney, Agent, or Firm* — Larson & Anderson, LLC

(57) ABSTRACT

The present invention relates to nucleic acid fragments encoding amino acid sequences for organic acid biosynthetic enzymes in plants, and the use thereof for the modification of, for example, organic acid biosynthesis and secretion in plants. In particularly preferred embodiments, the invention relates to the combinatorial expression of citrate synthase (CS) and/or malate dehydrogenase (MDH) and/or phosphoenolpyruvate carboxylase (PEPC) in plants to modify, for example, organic acid synthesis and secretion.

23 Claims, 138 Drawing Sheets

```
                    *         20         *         40         *         60
LpCSa1 : GNNTTATATTGACGGGGATGAGGGAATTCTTCGCTACAGAGGCTATCCAATTGAGGAGGT : 60
LpCSa2 : ------------------------------------------------------------ : -
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*         80         *        100         *        120
LpCSa1 : GGCTGAAAGCAGCTCGTTTGTTGAGGTCGCCTACCTCTTAATGTATGGGAATTTGCCCAC : 120
LpCSa2 : ------------------------------------------------------------ : -
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*        140         *        160         *        180
LpCSa1 : CCAGAGTCAACTGGCAGGCTGGGAGTTTGCAATTTCGCAGCACTCTGCTGTTCCTCAAGG : 180
LpCSa2 : ------------GCAGGCTGGGAGTTTGCAATTTCGCA-CACTCTGCTGTTCCTCANGN : 46
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*        200         *        220         *        240
LpCSa1 : ACTCTTGGATATAATACAATCAATGCCTCATGATGCCCACCCCATGGGTGTCCTTGCCAG : 240
LpCSa2 : ACTCTTGGATATAATACAATCAATGCCTCATGATGCCCACCCCATGGGTGTCCTTGCCAG : 106
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*        260         *        280         *        300
LpCSa1 : TGCAATGAGCACACTTTCAGTCTTCCATCCAGATGCAAACCCTGCTCTTAGAGGTCAAGA : 300
LpCSa2 : TGCAATGAGCACACTTTCAGTCTTCCATCCAGATGCAAACCCTGCTCTTAGAGGTCAAGA : 166
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -
```

FIGURE 1

```
                    *         320         *         340         *         360
LpCSa1 : TCTATACAAGTCGAAGCAGGTTAGGGATAAGCAAATTGTACGAGTTCTTGGGAAGGCACC : 360
LpCSa2 : TCTATACAAGTCGAAGCAGGTTAGGGATAAGCAAATTGTACGAGTTCTTGGGAAGGCACC : 226
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*         380         *         400         *         420
LpCSa1 : AGTAATAGCAGCTGCAGCCTATCTGAGATTAGCAGGAAGGCCTTTTGTCCTTCCTTCAAA : 420
LpCSa2 : AGTAATAGCAGCTGCAGCCTATCTGAGATTAGCAGGAAGGCCCTTTGTCCTTCCTTCAAA : 286
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*         440         *         460         *         480
LpCSa1 : TAATCTCTCTTATTCAGAAAATTTCTTGTATATGCTGGACTCTATGGGTGACAAAGATTA : 480
LpCSa2 : TAATCTCTCTTATTCAGAAAATTTCTTGTATATGCTGGACTCTATGGGTGACAAAGATTA : 346
LpCSa3 : ------------------------------------------------------------ : -
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*         500         *         520         *         540
LpCSa1 : TAAGCCAAATCCCAGACTTGCCCGGGTTCTGGATGTCCTTTTTATTCTTCATGCTGAACA : 540
LpCSa2 : TAAGCCAAATCCCAGACTTGCCCGGGTTCTGGATGTCCTTTTTATTCTTCATGCTGAACA : 406
LpCSa3 : --------------------------------------------NTTNTGCTG-ACA    :  12
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*         560         *         580         *         600
LpCSa1 : CGAAATGAACTGCTCAACAGCTGCTGTTAGGCACCTTGCTTCAAGTGGTGTCGATGTCTT : 600
LpCSa2 : CGAAATGAACTGCTCAACAGCTGCTGTTAGGCACCTTGCTTCAAGTGGTGTCGATGTCTT : 466
LpCSa3 : CGAAATGANCTGCTCAACAGCTGCTGTTAGGCACCTTGCTTCAAGTGGTGTCGATGTCTT :  72
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -
```

FIGURE 1 (cont.)

```
              *       520         *        640         *        660
LpCSa1 : CACTGCTCTTTCTGGTGCTGTTGGAGCTCTATATGGTCCACTGCATGGNGGCGCAAATGA : 660
LpCSa2 : CACTGCTCTTTCTGGTGCTGTTGGAGCTCTATATGGTCCACTGCATGGTGGCGCAAATGA : 526
LpCSa3 : CACTGCTCTTTCTGGTGCTGTTGGAGCTCTATATGGTCCACTGCATGGTGGCGCAAATGA : 132
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*       680         *        700         *        720
LpCSa1 : NGCGGTACTT-AAATGTTAAATGAGATTGGAAGTGTAGAGAATATTCCGGAATTCATTGA : 719
LpCSa2 : GGCGGTACTTAAAATGTTAAATGAGATTGGAAGTGTAGAGAATATTCCGGAATTCATTGA : 586
LpCSa3 : GGCGGTACTTAAAATGTTAAATGAGATTGGAAGTGTAGAGAATATTCCGGAATTCATTGA : 192
LpCSa4 : ------------------------------------------------------------ : -
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*       740         *        760         *        780
LpCSa1 : GGGAGTGAAGAACAGGAAGCGGAAAATGTCTGGNTTTGGGCACN---------------- : 763
LpCSa2 : GGGAGTGAAGAACAGGAAGCGGAAAATGTCTGGTTTTGGGCACCGTGTGTATAAGAATTA : 646
LpCSa3 : GGGAGTGAAGAACAGGAAGCGGAAAATGTCTGGCTTTGGGCACCGTGTGTATAAGAATTA : 252
LpCSa4 : ----------------------------------------------------------GA : 2
LpCSa5 : ------------------------------------------------------------ : -
LpCSa6 : ------------------------------------------------------------ : -
LpCSa7 : ------------------------------------------------------------ : -
LpCSa8 : ------------------------------------------------------------ : -

*       800         *        820         *        840
LpCSa1 : ------------------------------------------------------------ : -
LpCSa2 : TGATCCTCGTGCTAAAGTCATCCGGAAGTTAGCGGN------------------------ : 682
LpCSa3 : TGATCCTCGTGCTAAAGTCATCCGGAAGTTAGCGGAGGAGGTTTTCACGATTGTGGGACG : 312
LpCSa4 : TTATCCTCGCGCTAAAGTCAT-CCGGAGTTAGCGGAGGAGGTTTTCACGATTGTGGGACG : 61
LpCSa5 : ------------------GGAAGTTAGCGGAGGAGGTTTTCACGATTGTGGGACG : 37
LpCSa6 : ------------------------------------------------------------ : -
LpCSa7 : ------------------------------------------------------------ : -
LpCSa8 : ------------------------------------------------------------ : -

*       860         *        880         *        900
LpCSa1 : ------------------------------------------------------------ : -
LpCSa2 : ------------------------------------------------------------ : -
LpCSa3 : GGATCCTCTTATCGAGGTAGCTGTTGCTTTGGAGAAGGTAGCACTGTCAGACGAGTATTT : 372
LpCSa4 : GGATCCTCTTATCGAGGTAGCTGTTGCTTTGGAGAAGGCAGCACTGTCAGACGAGTATTT : 121
LpCSa5 : GCNTCCTCTTATCGAGGTAGCTGTTGCTTTGGAGAAGGCAGCACTGTCAGACGAGTATTT : 97
LpCSa6 : ---------------------------------------TNNCAGACGAGTATTT : 16
LpCSa7 : ----------------------------------------GTCAGACGAGTATTT : 15
LpCSa8 : ------------------------------------------------------------ : -
```

FIGURE 1 (cont.)

```
                    *         920         *         940         *         960
LpCSa1 : ------------------------------------------------------------ :   -
LpCSa2 : ------------------------------------------------------------ :   -
LpCSa3 : TATCAAGAGGAAGCTGTATCCAAATGTGGATTTTTATTCTGGCCTAATATATAGGGCAAT : 432
LpCSa4 : TATCAAGAGGAAGCTGTATCCAAATGTGGATTTTTATTCTGGCCTAATATATAGGGCAAT : 181
LpCSa5 : TATCGAGAGGAAGCTGTATCCAAATGTGGATTTTTATTCTGGCCTAATATATAGGGCAAT : 157
LpCSa6 : TATCAAGAGGAAGCTGTATCCAAATGTGGATTTTTATTCTGGCCTAATATATAGGGCAAT :  76
LpCSa7 : TATCAAGAGGAAGCTGTATCCAAATGTGGATTTTTATTCTGGCCTAATATATAGGGCAAT :  75
LpCSa8 : ------------------------------------------------------------ :   -

*         980         *        1000         *        1020
LpCSa1 : ------------------------------------------------------------ :   -
LpCSa2 : ------------------------------------------------------------ :   -
LpCSa3 : GGGATTCCCTACAGAGTTTTTCCCTGTTCTGTTTGCAGTTCCTCGCATGGCTGGTTGGTT : 492
LpCSa4 : GGGATTCCCTGCAGAGTTTTTCCCTGTTCTGTTTGCAGTTCCTCGCATGGCTGGTTGGTT : 241
LpCSa5 : GGGATTCCCTACAGAGTTTTTCCCTGTTCTGTTTGCAGTTCCTCGCATGGCTGGTTGGTT : 217
LpCSa6 : GGGATTCCCTACAGAGTTTTTCCCTGTTCTGTTTGCAGTTCCTCGCATGGCTGGTTGGTT : 136
LpCSa7 : GGGATTCCCTACAGAGTTTTTCCCTGTTCTGTTTGCAGTTCCTCGCATGGCTGGTTGGTT : 135
LpCSa8 : ------------------------------------------------------------ :   -

*        1040         *        1060         *        1080
LpCSa1 : ------------------------------------------------------------ :   -
LpCSa2 : ------------------------------------------------------------ :   -
LpCSa3 : AGCACATTGGAAGGAGTCACTTGATGACCCCGACAATAAAATTATGAGGCCCCAACAGGT : 552
LpCSa4 : AGCACATTGGAAGGAGTCACTTGATGACCCCGACAATAAAATTATGAGGCCCCAACAGGT : 301
LpCSa5 : AGCACATTGGAAGGAGTCACTTGATGACCCCGACAATAAAATTATGAGGCCCCAACAGGT : 277
LpCSa6 : AGCACATTGGAAGGAGTCACTTGATGACCCCGACAATAAAATTATGAGGCCCCAACAGGT : 196
LpCSa7 : AGCACATTGGAAGGAGTCACTTGATGACCCCGACAATAAAATTATGAGGCCCCAACAGGT : 195
LpCSa8 : ------------------------------------------------------------ :   -

*        1100         *        1120         *        1140
LpCSa1 : ------------------------------------------------------------ :   -
LpCSa2 : ------------------------------------------------------------ :   -
LpCSa3 : ATACACCGGTACTTGGCTAAGGCATTACACCCCAGTGAGAGAACGGGTGCCATCAAGCGA : 612
LpCSa4 : ATACACCGGTACTTGGCTAAGGCATTACACCCCAGTGAGAGAACGGGTGCCATCAAGCGA : 361
LpCSa5 : ATACACCGGTACTTGGCTAAGGCATTACACCCCAGTGAGAGAACGGGTGCCATCAAGCGA : 337
LpCSa6 : ATACACCGGTACTTGGCTAAGGCATTACACCCCAGTGAGAGAACGGGTGCCATCAAGCGA : 256
LpCSa7 : ATACACCGGTACTTGGCTAAGGCATTACACCCCAGTGAGAGAACGGGTGCCATCAAGCGA : 255
LpCSa8 : ------------------------------------------------------------ :   -

1160         *        1180         *        1200
LpCSa1 : ------------------------------------------------------------ :   -
LpCSa2 : ------------------------------------------------------------ :   -
LpCSa3 : CAGTGAGCAGCTTGGGCAGATCACTACATCAAACGCGACGAGGCGTCGGCGTGCTGGTTC : 672
LpCSa4 : CAGTGAGCAGCTTGGGCAGATCGCTACATCAAACGCGACGAGGCGTCGGCGTGCTGGCTC : 421
LpCSa5 : CAGTGAGCAGCTTGGGCAGATCGCTACATCAAACGCGACGAGGCGTCGGCGTGCTGGCTC : 397
LpCSa6 : CAGTGAGCAGCTTGGGCAGATCGCTACATCAAACGCGACGAGGCGTCGGCGTGCTGGCTC : 316
LpCSa7 : CAGTGAGCAGCTTGGGCAGATCGCTACATCAAACGCGACGAGGCGTCGGCGTGCTGGCTC : 315
LpCSa8 : -------------GGCAGATCGCT-CATCAAACGCGTCGAGGCGTCGGCGTGCTGGCTC :  45
```

FIGURE 1 (cont.)

```
              *         1220         *         1240         *         1260
LpCSa1 : ---------------------------------------------------------------- :   -
LpCSa2 : ---------------------------------------------------------------- :   -
LpCSa3 : TGCCCTGTAGAACAGTCTGCATGATACAGCATACAGTCCACACAATAAACCAAGCTGCCA     : 732
LpCSa4 : TGCCCTGTAGAACAGTCTGCATGATACAGCATACAGTCCACACAATAAACCAAGCTGCCA     : 481
LpCSa5 : TGCCCTGTAGAACAGTCTGCATGATACAGCATACAGTCCACACAATAAACCAAGCTGCCA     : 457
LpCSa6 : TGCCCTGTAGAACAGTCTGCATGATACAGCATACAGTCCACACAATAAACCAAGCTGCCA     : 376
LpCSa7 : TGCCCTGTAGAACAGTCTGCATGATACAGCATACAGTCCACACAATAAACCAAGCTGCCA     : 375
LpCSa8 : TGCCCTGTAGAACAGTCTGCATGATACAGCATACAGTCCACACAATAAACCAAGCTGCCA     : 105

*         1280         *         1300         *         1320
LpCSa1 : ---------------------------------------------------------------- :   -
LpCSa2 : ---------------------------------------------------------------- :   -
LpCSa3 : AGGGCCACGGCTGCTTAAATN------------------------------------------  : 753
LpCSa4 : AGGGCCACGGCTGCTTAAATCTGGGAGCTGCTATACTTGTGTTATCACGTATATGTAGGC    : 541
LpCSa5 : AGGGCCACAGCTGCTTAAATCTGGGAGCTGCTATACTTGTGTTATCACGTATATATAGGC    : 517
LpCSa6 : AGGGCCACGGCTGCTTAAATCTGGGAGCTGCTATACTTGTGTTATCACGTATATATAGGC    : 436
LpCSa7 : AGGGCCACGGCTGCTTAAATCTGGGAGCTGCTATACTTGTGTTATCACGTATATATAGGC    : 435
LpCSa8 : AGGGCCACGGCTGCTTAAATCTGGGAGCTGCTATACTTGTGTTATCACGTATATATAGGC    : 165

*         1340         *         1360         *         1380
LpCSa1 : ---------------------------------------------------------------- :   -
LpCSa2 : ---------------------------------------------------------------- :   -
LpCSa3 : ---------------------------------------------------------------- :   -
LpCSa4 : AATAAACTAATAATGCCGCCAGGACACTTCACTGGTGGTCATGTGAAGTTGGTAGTAGAA     : 601
LpCSa5 : AATAAACTAATAATGCCGCCAGGACACTTCACTGGTGGTCATGTGAAGTTGGTAGTAGAA     : 577
LpCSa6 : AATAAACTAATAATGCCGCCAGGACACTTCACTGGTGGTCATGTGAAGTTGGTAGTAGAA     : 496
LpCSa7 : AATAAACTAATAATGCCGCCAGGACACTTCACTGGTGGTCATGTGAAGTTGGTAGTAGAA     : 495
LpCSa8 : AATAAACTAATAATGCCGCCAGGACACTTCACTGGTGGTCATGTGAAGTTGGTAGTAGAA     : 225

*         1400         *         1420         *         1440
LpCSa1 : ---------------------------------------------------------------- :   -
LpCSa2 : ---------------------------------------------------------------- :   -
LpCSa3 : ---------------------------------------------------------------- :   -
LpCSa4 : TGCACTTGTAACGTGTTGTTAATTTGTTATCCTGCAATGTACGCTCTATAAACTGTTCAG    : 661
LpCSa5 : TGCACTTGTAACGTGTTGTTAATTTGTTATCCTGCAATGTACGCTCTATAAACTGTTCAG    : 637
LpCSa6 : TGCACTTGTAACGTGTTGTTAATTTGTTATCCTGCAATGTACGCTCTATAAACTGTTCAG    : 556
LpCSa7 : TGCACTTGTAACGTGTTGTTAATTTGTTATCCTGCAATGTACGCTCTATAAACTGTTCAG    : 555
LpCSa8 : TGCACTTGTAACGTGTTGTTAATTTGTTATCCTGCAATGTACGCTCTATAAACTGTTCAG    : 285

*         1460         *         1480         *         1500
LpCSa1 : ---------------------------------------------------------------- :   -
LpCSa2 : ---------------------------------------------------------------- :   -
LpCSa3 : ---------------------------------------------------------------- :   -
LpCSa4 : TGTCTTGAAAGTCTTAATCATGTGGACCAA-GAAGACATAGATCAAGTTCTTTGCATGGG    : 720
LpCSa5 : TATCTTGAAAGTCTTANTCCNNNNAAAAA-------------------------------    : 666
LpCSa6 : TATCTTGAAAGTCTTAATCATGTGGACCAA-GAAGACATAGATCAAGTTCTTTGCATGGG    : 615
LpCSa7 : TATCTTGAAAGTCTTAATCATGTGGACCAATCAAAAAAAAAA------------------    : 597
LpCSa8 : TATCTTGAAAGTCTTAAAAAAAAAA-----------------------------------    : 310
```

FIGURE 1 (cont.)

```
                    *        1520         *        1540         *
LpCSa1 : ------------------------------------------------------ :   -
LpCSa2 : ------------------------------------------------------ :   -
LpCSa3 : ------------------------------------------------------ :   -
LpCSa4 : CGGCGGCTGTTTCTTTGGNAAAAAA----------------------------- : 745
LpCSa5 : ------------------------------------------------------ :   -
LpCSa6 : CGGCGGCTGTTTCTTTGTGTTTCCTCTTTTTATGGGAGTCTTTTTTTTACC    : 665
LpCSa7 : ------------------------------------------------------ :   -
LpCSa8 : ------------------------------------------------------ :   -
```

FIGURE 1 (cont.)

```
              *        20         *        40         *        60
LpCSb1 : CTTCTCCCTGTNACTGCTCTCCAATGACACAGTTTACCACTGGAGTGATGGCACTCCAAG :  60
LpCSb2 : ------------------------------------------------------------ :   -
LpCSb3 : ------------------------------------------------------------ :   -
LpCSb4 : ------------------------------------------------------------ :   -

*        80         *       100         *       120
LpCSb1 : TTGAGAGTGAATTTGCAAAGGCTTATGAGAAGGGAATTCATAAATCAAAGTTCTGGGAGC : 120
LpCSb2 : ------------------------------------------------------------ :   -
LpCSb3 : ------------------------------------------------------------ :   -
LpCSb4 : ------------------------------------------------------------ :   -

*       140         *       160         *       180
LpCSb1 : CTACATATGAAGATAGCTTAAATTTGATTGCTCGGCTTCCACAAGTGGCTTCATATGTTT : 180
LpCSb2 : ------------------------------------------------------------ :   -
LpCSb3 : ------------------------------------------------------------ :   -
LpCSb4 : ------------------------------------------------------------ :   -

*       200         *       220         *       240
LpCSb1 : ACCGGAGAATTTTCAAGGACGGGAAAACTATTGCAGCTGATAATACACTGGACTACGCAG : 240
LpCSb2 : ------------------------------------------------------------ :   -
LpCSb3 : ------------------------------------------------------------ :   -
LpCSb4 : ------------------------------------------------------------ :   -

*       260         *       280         *       300
LpCSb1 : CTAATTTTTCACACATGCTTGGTTTTGATGACCCCAAAATGCTGGAGTTGATGCGCCTAT : 300
LpCSb2 : ------------------------------------------------------------ :   -
LpCSb3 : ------------------------------------------------------------ :   -
LpCSb4 : ------------------------------------------------------------ :   -

*       320         *       340         *       360
LpCSb1 : ACATAACAATTCACACTGATCACGAAGGAGGGAATGTTAGTGCTCATGCTGGGCATCTGG : 360
LpCSb2 : ------------------------------------------------------------ :   -
LpCSb3 : ------------------------------------------------------------ :   -
LpCSb4 : ------------------------------------------------------------ :   -

*       380         *       400         *       420
LpCSb1 : TTGGAAGTGCTCTGTCAGATCCTTATCTTTCTTTTGCAGCGGCACTGAACGGTTTAGCTG : 420
LpCSb2 : ------------------------------------------------------------ :   -
LpCSb3 : ------------------------------------------------------------ :   -
LpCSb4 : ------------------------------------------------------------ :   -

*       440         *       460         *       480
LpCSb1 : GACCACTGCACGGCTTGGCTAATCAGGAAGTGTTGTTATGGATCAAATCTGTGATGGAAG : 480
LpCSb2 : ---------------------------------------TNATGGAT-NAATCTGTGATGGAAG :  24
LpCSb3 : ------------------------------------------------------------ :   -
LpCSb4 : ------------------------------------------------------------ :   -
```

FIGURE 2

```
               *         500         *         520         *         540
LpCSb1 : AAACCGGGAGTAACATTACAACTGATCAGCTTAAAGAATATGTTTGGAAGACACTGAAGA : 540
LpCSb2 : -AACCGGGAGTAACATTACAACTGATCAGCTTAAAGAATATGTTTGGAAGACACTGAAGA :  83
LpCSb3 : ----------------------------------------------------CTGAAGA :   7
LpCSb4 : ------------------------------------------------------------ :   -

*         560         *         580         *         600
LpCSb1 : GTGGAAAGGTTGTTCCTGGCTATGGTCATGGAGTTCTACGTAATACAGATCCACGATACT : 600
LpCSb2 : GTGGAAAGGTTGTTCCTGGCTATGGTCATGGAGTTCTACGTAATACAGATCCACGATACT : 143
LpCSb3 : GTGGAAAGGTTGTTCCTGGCTATGGTCATGGAGTTCTACGTAATACAGATCCACGATACT :  67
LpCSb4 : ------------------------------------------------------------ :   -

*         620         *         640         *         660
LpCSb1 : CGTGCCAAAGGGAGTTTGCACTGAAGTATTTACCTGAAGACCCACTTTTCCAACTGGTCT : 660
LpCSb2 : CGTGCCAAAGGGAGTTTGCACTGAAGTATTTACCCGAAGACCCACTTTTCCAACTGGTCT : 203
LpCSb3 : CGTGCCAAAGGGAGTNGGNACTGAAGTATTTACCCGAAGACCCACTTTTCCAACTGGTCT : 127
LpCSb4 : ------------------------------------------------------------ :   -

*         680         *         700         *         720
LpCSb1 : CCAAGTTGTATGAAGTTGTGCCTCCTATCCTCACTGAGTTAGGCAAGGTAAAAAACCCAT : 720
LpCSb2 : CCAAGTTGTATGAAGTTGTGCCTCCTATCCTCACGAGTTAGGCAAGGTAAAAAACCCAT : 263
LpCSb3 : CCAAGTTGTACGAAGTTGTGCCTCCTATCCTCACCGAGTTAGGCAAGGTAAAAAACCCAT : 187
LpCSb4 : ------------------------------------------------------------ :   -

*         740         *         760         *         780
LpCSb1 : GGCCTAATGTTGATGCTCACAGNGGAGTTTTGCTCAACCACTTCGGATTAGTTGAA-CAC : 779
LpCSb2 : GCCCTAATGTTGATGCTCACAGTGGAGTTTTGCTCAACCACTTCGGATTAGTTGAAGCAC : 323
LpCSb3 : GGCCTAATGTTGATGCTCACAGTGGAGTTTTGCTCAACCACTTCGGATTAGTTGAAGCAC : 247
LpCSb4 : ------------------------------------------------------------ :   -

*         800         *         820         *         840
LpCSb1 : GGNACTACACTGNCTTGNTCGGN------------------------------------- : 802
LpCSb2 : GGTACTACACTGTCTTGTTCGGCGTCTCAAGGAGCATGGGAATTGGATCTCAGCCCATTT : 383
LpCSb3 : GGTACTACACTGTCTTGTTCGGCGTCTCAAGGAGCATGGGAATTGGATCTCAGCTCATTT : 307
LpCSb4 : ----------------------------------------GTTTTTCCATCCCAGCTCATTT :  22

*         860         *         880         *         900
LpCSb1 : ------------------------------------------------------------ :   -
LpCSb2 : GGGACCGTGCCCTCGGCCTGCCACTTGAAAGACCGAAGAGTGTCACCATGGAGTGGCTGG : 443
LpCSb3 : GGGACCGTGCCCTCGGCCTGCCACTTGAAAGACCGAAGAGTGTCACCATGGAGTGGCTGG : 367
LpCSb4 : GGGTCCGTGCCCTCGGCCTGCCACTTGAAAGACCGAAGAGTGTCACCATGGAGTGGCTGG :  82

*         920         *         940         *         960
LpCSb1 : ------------------------------------------------------------ :   -
LpCSb2 : AAAACCACTGCAAGAAGGCTGCGGCCTGAAGCTACACCAATGCTTCGTTTTACAAATCAG : 503
LpCSb3 : AAAACCACTGCAAGAAGGCTGCGGCCTGAAGCTACACCAATGCTTNGTTTTACAAATCAN : 427
LpCSb4 : AAAACCACTGCAAGAAGGCTGCGGCCTGAAGCTACACCAATGCTTCGTTTTACAAATCAG : 142
```

FIGURE 2 (cont.)

```
                  *         980         *        1000         *        1020
LpCSb1 : ------------------------------------------------------------  :   -
LpCSb2 : GCCGTCTTTGATGTTAATAATGACTGAGCATAAGTTAGGCATGGTTAGCCTTGTTTTACC  : 563
LpCSb3 : GCCGTCTTTGATGTTAATAATGACTGAGCATAAGTTAGGCATGGCTAGCCTTGTTTTACC  : 487
LpCSb4 : GCCGTCTTTGATGTTAATAATGACTGAGCATAAGTTAGGCATGGTTAGCCTTGTTTTACC  : 202

*        1040         *        1060         *        1080
LpCSb1 : ------------------------------------------------------------  :   -
LpCSb2 : ATCTTCGTTTTCCTGGCCAATAACTGGAGCAAGAGGCTTACAGACGGTAGAATTTTGTAA  : 623
LpCSb3 : ATNTTCGTTTTCCTGGCCAATAACTGGAGCAAGAGGCTCACAGACGGTAGAATTTTGTAA  : 547
LpCSb4 : ATCTTCGTTTTCCTGGCCAATAACTGGAGCAAGAGGCTCACAGACGGTAGAATTTTGTAA  : 262

*        1100         *        1120         *        1140
LpCSb1 : ---------------------------------------------------------    :   -
LpCSb2 : CCACCGNTACTTGAACACCGAATCANTTAAATGTCATTTGGCATAAAGAGATTAGGACAT  : 683
LpCSb3 : CCACCGGTACTTG-ACACCGAATNANNTAAATGGNATTTGGCATAAAGAGATTAGGACAT  : 606
LpCSb4 : CCACCGTTACTTGAACACCGAATCAGTTAAATGTCATTTGGCATAAAGAGATTAGGACAT  : 322

*        1160
LpCSb1 : --------------------------  :   -
LpCSb2 : GACACATAAGTTTTATGTGNCGNTCGG  : 710
LpCSb3 : GACACATAAGTTTTATGTGTCGCTCGG  : 633
LpCSb4 : GACACATAAGTTTTATGTGTCGCTCGA  : 349
```

FIGURE 2 (cont.)

```
                  *         20         *         40         *         60
LpMDHa1 : GTTTGGTTGCTGGTATCACCATTCTGCCCTGTTCTCACAGGCAACTCCTTCGACTAATGC  :  60
LpMDHa2 : -GCTGGTTGCTGGTATCACCATTCTGCCCTGTTCTCACAGGCAACTCCTTCGACTAATGC  :  59
LpMDHa3 : -GTGGTCTGCTGGTATCACCATTCTGCCCTGTTCTCACAGGCAACTCCTTCGACTAATGC  :  59
LpMDHa4 : ----GGTTGCTGGTATCACCATTCTGCCCTGTTCTCACAGGCAACTCCTTCGACTAATGC  :  56
LpMDHa5 : ------------------------------------------------------------  :   -
LpMDHa6 : ------------------------------------------------------------  :   -
LpMDHa7 : ------------------------------------------------------------  :   -

*         80         *        100         *        120
LpMDHa1 : ATTGTCTAGTGAAGACATCAAGGCTCTCACCAAGAGGACACAGGAGGGTGGGACAGAAGT  :120
LpMDHa2 : ATTGTCTAGTGAAGACATCAAGGCTCTCACCAAGAGGACACAGGAGGGTGGGACAGAAGT  :119
LpMDHa3 : ATTGTCTAGTGAAGACATCAAGGCTCTCACCAAGAGGACACAGGAGGGTGGGACAGAAGT  :119
LpMDHa4 : ATTGTCTAGTGAAGACATCAAGGCTCTCACCAAGAGGACACAGGAGGGTGGGACAGAAGT  :116
LpMDHa5 : -------------------------------------------GAGGGTGGGACAGAAGT  : 17
LpMDHa6 : ------------------------------------------------------------  :   -
LpMDHa7 : ------------------------------------------------------------  :   -

*        140         *        160         *        180
LpMDHa1 : TGTTGAGGCAAAGGCTGGAAAGGGATCTGCAACCTTGTCCATGGCGTATGCTGGCGCAGT  :180
LpMDHa2 : TGTTGAGGCAAAGGCTGGAAAGGGATCTGCAACCTTGTCCATGGCGTATGCTGGCGCAGT  :179
LpMDHa3 : TGTTGAGGCAAAGGCTGGAAAGGGATCTGCAACCTTGTCCATGGCGTATGCTGGCGCAGT  :179
LpMDHa4 : TGTTGAGGCAAAGGCTGGAAAGGGATCTGCAACCTTGTCCATGGCGTATGCTGGCGCAGT  :176
LpMDHa5 : TGTTGAGGCAAAGGCTGGAAAGGGATCTGCAACCTTGTCCATGGCGTATGCTGGCGCAGT  : 77
LpMDHa6 : ------------------------------------------------------------  :   -
LpMDHa7 : ------------------------------------------------------------  :   -

*        200         *        220         *        240
LpMDHa1 : TTTTGGTGATGCATGCTTGAAGGGTCTGAACGGAGTTCCTGACATTGTTGAATGCTCCTA  :240
LpMDHa2 : TTTTGGTGATGCATGCTTGAAGGGTCTGAACGGAGTTCCTGACATTGTTGAATGCTCCTA  :239
LpMDHa3 : TTTTGGTGATGCATGCTTGAAGGGTCTGAACGGAGTTCCTGACATTGTTGAATGCTCCTA  :239
LpMDHa4 : TTTTGGTGATGCATGCTTGAAGGGTCTGAACGGAGTTCCTGACATTGTTGAATGCTCCTA  :236
LpMDHa5 : TTTTGGTGATGCATGCTTGAAGGGTCTGAACGGAGTTCCTGACATTGTTGAATGCTCCTA  :137
LpMDHa6 : ------------------------------------------------------------  :   -
LpMDHa7 : ------------------------------------------------------------  :   -

*        260         *        280         *        300
LpMDHa1 : CGTGCAATCAACTATCACAGAACTGCCATTCTTTGCCTCCAAGGTGAGGCTCGGGAAGAA  :300
LpMDHa2 : CGTGCAATCAACTATCACAGAACTGCCATTCTTTGCCTCCAAGGTGAGGCTCGGGAAGAA  :299
LpMDHa3 : CGTGCAATCAACTATCACAGAACTGCCATTCTTTGCCTCCAAGGTGAGGCTCGGGAAGAA  :299
LpMDHa4 : CGTGCAATCAACTATCACAGAACTGCCATTCTTTGCCTCCAAGGTGAGGCTCGGGAAGAA  :296
LpMDHa5 : TGTGCAATCAACTATCACAGAACTGCCATTCTTTGCCTCCAAGGTGAGGCTCGGGAAGAA  :197
LpMDHa6 : ------------------------------------GTNANGCTCGGNNAGAA  : 17
LpMDHa7 : ----------------------------------------------------------AA  :   2
```

FIGURE 3

```
                        *         320         *         340         *         360
LpMDHa1 : TGGAGTCGAGGAAGTGCTTGGTTTGGGTGAGCTGTCGGCCTTTGAGAAGGAAGGTTTGGA :360
LpMDHa2 : TGGAGTCGAGGAAGTGCTTGGTTTGGGTGAGCTGTCGGCCTTTGAGAAGGAAGGTTTGGA :359
LpMDHa3 : TGGAGTCGAGGAAGTGCTTGGTTTGGGTGAGCTGTCGGCCTTTGAGAAGGAAGGTTTGGA :359
LpMDHa4 : TGGAGTCGAGGAAGTGCTTGGTTTGGGTGAGCTGTCGGCCTTTGAGAAGGAAGGTTTGGA :356
LpMDHa5 : TGGAGTCGAGGAAGTGCTTGGTTTGGGTGAGCTGTCGGCCTTTGANAAGGAAGGTTTGGA :257
LpMDHa6 : TGGAGTCGAGGAAGTGCTTGGTTTGGGTGAGCTGTCGGCCTTTGAGAAGGAAGGTTTGGA : 77
LpMDHa7 : TGGAGTCGAGGAAGTGCTTGGTTTGGGTGAGCTGTCGGCCTTTGAGAAGGAAGGTTTGGA : 62

*         380         *         400         *         420
LpMDHa1 : AAGTCTCAAGGGTGAGCTCAAGTCTTCAATTGACAAGGGCATCGCGTTCGCCAATGCGAG :420
LpMDHa2 : AAGTCTCAAGGGTGAGCTCAAGTCTTCAATTGACAAGGGCATCGCGTTCGCCAATGCGAG :419
LpMDHa3 : AAGTCTCAAGGGTGAGCTCAAGTCTTCAATTGACAAGGGCATCGCGTTCGCCAATGCGAG :419
LpMDHa4 : AAGTCTCAAGGGTGAGCTCAAGTCTTCAATTGACAAGGGCATCGCGTTCGCCAATGCGAG :416
LpMDHa5 : AAGTCTCAAGGGTGAGCTCAAGTCTTCAATTGACAAGGGCATCGCGTTCGCCAATGCGAG :317
LpMDHa6 : AAGTCTCAAGGGTGAGCTCAAGTCTTCAATTGACAAGGGCATCGCGTTCGCCAATGCGAG :137
LpMDHa7 : AAGTCTCAAGGGTGAGNTCAAGTCTTCAATTGACAAGGGCATCGCGTTCGCCAATGCGAG :122

*         440         *         460         *         480
LpMDHa1 : TTAATTAATTTTGCAGATTATAGCAAACCAGGTCTAGTTAAGGGGTCTG---TTG--TTT :475
LpMDHa2 : TTAATTAATTTTGCAGATTATAGCAAACCAGGTCTAGTTAAGGGGTCTG---TTG--TTT :474
LpMDHa3 : TTAATTAATTTTGCAGATTATAGCAAACCAGGTCTAGTTAAGGGGTCTG---TTG--TTT :474
LpMDHa4 : TTAATTAATTTTGCAGATTATAGCAAACCAGGTCTAGTTAAGGGGTCTG---TTG--NTT :471
LpMDHa5 : TTGATTAAATTTGCAGATTATAGCAATCCAGGTCTAGTTGAGGGGTCTGTTTTTGACTTT :377
LpMDHa6 : TTGATTAAATTTGCAGATTATAGCAATCCAGGTCTAGTTGAGGGGTCTGTTTTTGACTTT :197
LpMDHa7 : TTGATTAAATTTGCAGATTATAGCAATCCAGGTCTAGTTGAGGGGTCTGTTTTTGACTTT :182

*         500         *         520         *         540
LpMDHa1 : TTGTTCAGTGCTTTTTCTGCCCATCACGTGGGCATGGAAGATTTGAGCTTCACAATAAAA :535
LpMDHa2 : TTGTTCAGTGCTTTTTCTGCCCATCACGTGGGCATGGAAGATTTGAGCTTCACAATAAAA :534
LpMDHa3 : TTGTTCAGTGCTTTTTCTGCCCATCACGTGGGCATGGAAGATTTGAGCTTCACAATAAAA :534
LpMDHa4 : TTGNTCANNGCTTTTTCTGCCCATCACGTGNGCATCNAAGATTTGAGCTTNACANTANNT :531
LpMDHa5 : TTGTTCAGNGCTTTTTCTGCCCATCACGTGGGCATGGAAGATTTGAGCTTCACAATAAAA :437
LpMDHa6 : TTGTTCAGTGCTTTTTCTGCCCATCACGTGGGCATGGAAGATTTGAGCTTCACAATAAAA :257
LpMDHa7 : TTGTTCAGTGCTTTTTCTGCCCATCACGTGGGCATGGAAGATTTGAGCTTCACAATAAAA :242

*         560         *         580         *         600
LpMDHa1 : ATCCGGCGGCGTAATGCCACAGAACATTACTTGTACAAGAGGGAACTAGTTCGTGTCAAG :595
LpMDHa2 : ATCCGGCGGCGTAATGCCACAGAACATTACTTGTACAAGAGGGAACTAGTTCGTGTCAAG :594
LpMDHa3 : ATCCGGCGGCGTAATGCCACAGAACATTACTTGTACAAGAGGGAACTAGTTCGTGTCAAG :594
LpMDHa4 : ATNCCNGCGGCGNN---------------------------------------------- :544
LpMDHa5 : ATCCGGCGGCGTAATGCCACANAACATTACTTGACAAGAGGGAACTAGTTCGGGTNAAG :497
LpMDHa6 : ATCCGGCGGCGTAATGCCACAGAACATTACTTGTACAAGAGGGAACTAGTTCGTGTCAAG :317
LpMDHa7 : ATCCGGCGGCGTAATGCCACAGAACATTACTTGTACAAGAGGGAACTAGTTCGTGTCAAG :302
```

FIGURE 3 (cont.)

```
                    *         620         *         640         *         660
LpMDHa1 : TTTTGAACTGGTACATTAAACGAACAATTGCTGATGCACTTTGAGAAAAAAAAN-----  :650
LpMDHa2 : TTTTGAACTGGTACATTAAACGAACAATTGCTGATGCACTTTGAGAAAAAAAAA-----  :649
LpMDHa3 : TTTTGAACTGGTACATTAAACGAACAATTGCTGATGCACTTTGAGAAAAAAAAA-----  :649
LpMDHa4 : ------------------------------------------------------------  :  -
LpMDHa5 : TTTTGAACTGGNACATTAAACAACCAATTGTTGTGCCCCTTTGNGAACGGCCCTTTGGGG  :557
LpMDHa6 : TTTTGAACTGGTACATTAAACGAACAATTGTTGATGCACTTTGTGAACCGTCCTTTGGTG  :377
LpMDHa7 : TTTTGAACTGGTACATTAAACGAACAATTGTTGAAAAAAAAAA-----------------  :345

*         680         *
LpMDHa1 : -------------------------------------  :  -
LpMDHa2 : -------------------------------------  :  -
LpMDHa3 : -------------------------------------  :  -
LpMDHa4 : -------------------------------------  :  -
LpMDHa5 : GTGANTCCATTGGNCTNAAGCCNAAAAAAAAA----  : 589
LpMDHa6 : TTGATTCCATTGTCTTCAAGTTAACGAANAANAAAA  : 413
LpMDHa7 : -------------------------------------  :  -
```

FIGURE 3 (cont.)

```
              *        20         *        40         *        60
LpMDHb1 : TTTGGTNCTTTTGCCGAG-NANTAATCTGTTCGGTGTCACCACCCTTGNGTTGTTCGTGCT :  60
LpMDHb2 : ------------------GCGAGACAGCTGTTTGGTGTCACCACCCTTGTGTTGTTCGTGCT :  44

*        80         *       100         *       120
LpMDHb1 : AAAACTTTCTACGCTGGGAAGGCAAACGTGCCAGTCACTGGGGTGAATGTTCCTGTTGTTG : 121
LpMDHb2 : AAAACTTTCTACGCTGGGAAGGCAAACGTGCCCGTCACTGGGGTGAATGTTCCTGTTGTTG : 105

*       140         *       160         *       180
LpMDHb1 : GTGGCCATGCTGGTGTTACTATCCTGCCACGGTTCTCACAGGCTACTCCTGCAAGTAATGC : 182
LpMDHb2 : GTGGCCATGCTGGTGTTACTATCCTGCCACAGTTCTCACAGGCTACTCCTGCAAGTAATGC : 166

*       200         *       220         *       240
LpMDHb1 : ATTGTCCCATGAGGATCTTAAGGCCCTCACCAAGAGGACACAAGATGGTGGGACGGAAGTT : 243
LpMDHb2 : ATTGTCCCATGAGGACCTTAAGGCCCTCACCAAGAGGACACAAGATGGTGGGACGGAAGTT : 227

*       260         *       280         *       300
LpMDHb1 : GTTGAAGCAAAGGCTGGAAAGGGCTCAGCAACATTGTCAATGGCATATGCTGGTGCAGTAT : 304
LpMDHb2 : GTTGAAGCAAAGGCTGGAAAGGGCTCAGCAACATTGTCGATGGCATATGCTGGTGCAGTTT : 288

*       320         *       340         *       360
LpMDHb1 : TTGGAGATGCATGCTTGAAGGGGCTCAATGGAGTTCCTGACATTGTAGAGTGCTCCTTTGT : 365
LpMDHb2 : TTGGAGATGCATGCTTGAAGGGGCTCAATGGAGTTCCTGACATTGTAGAGTGCTCCTTTGT : 349

*       380         *       400         *       420
LpMDHb1 : GCAATCAACTGTAACAGAGCTGCCATTCTTTGCCTCCAAGGTAAGGCTCGGCAAGAACGGA : 426
LpMDHb2 : GCAATCAACCGTAACAGAGCTGCCATTCTTTGCCTCCAAGGTAAGGCTCGGCAAGAACGGA : 410

*       440         *       460         *       480
LpMDHb1 : GTGGAGGAAGTGATTGGGCTGGGCGAGCTGTCTGCCTTCGAGAAGGAGGGTCTGGAGAGCC : 487
LpMDHb2 : GTGGAGGAAGTGATTGGGCTGGGCGAGCTGTCTGCCTTCGAGAAGGAGGGTCTGGAGAGCC : 471

*       500         *       520         *       540
LpMDHb1 : TCAAGGGCGAGCTGNTGNCCTCCATCGAGAAGGGTATCAAGTTCGCGCAGGAGAGCTAGTC : 548
LpMDHb2 : TCAAGGGCGAGCTGTTGCCCTCCATTGAGAAGGGTATCAAGTTCGCTCAGGAGAGCTAGTC : 532

*       560         *       580         *       600         *
LpMDHb1 : AACCTGCTCAGATTCTAACACTCCGCACATGAACTCGGTGGGATCTGATGAATTTTTGGTA : 609
LpMDHb2 : AACCTGCTCAGATTCTAACACTCCGCACATGAACTCGGTGGGATCTGATGAATTTTTGGTT : 593

620         *       640         *       660         *
LpMDHb1 : CGACTCCTTTCTCTGCCCCTTTTTCGTGGGGACATTGAGGCGTTGNGCTTCACATTAAAAT : 670
LpMDHb2 : CGACTCCTTTCACTGCCCCCTTCTCCTGGGGACATTGAGGCGTCGTGCTCCACAATAAAAT : 654
```

FIGURE 4

```
              680         *         700         *         720         *
LpMDHb1 : GGCGTGN TTGTTG-CATACTGA CTGA CTT TA T N------------------------ : 708
LpMDHb2 : GGCGTG TCTTGTTGCCATACTGAACTGAACTTGTAATACCAGAAAGAGTGAAACCCTGTGC : 715

740         *         760         *         780         *
LpMDHb1 : ------------------------------------------------------------ :  -
LpMDHb2 : CTTATGTACCACAGTACGGTGAACCCGAAAATCATGAAGGTAGCAGAAGATTCTGTGGAAG : 776

800
LpMDHb1 : --------------- :  -
LpMDHb2 : CTTTTTTCTTTTTAN : 790
```

FIGURE 4 (cont.)

```
              *         20         *         40         *         60
LpMDHf1 : GNNNTGATTNATNCAACAAAAATGCTGGGCATTGTCCGATCAATCTGTGAGGGCGTTGCC :  60
LpMDHf2 : -GGATGATTTATTCAACAAAAATGCTGGG-ATTGTCCGATCAATCTGTGAGGGCGTTGCC :  58

*         80         *        100         *        120
LpMDHf1 : AAGAGCTGTCCTAATGCAATAGTGAATTTGATCAGCAACCCTGTGAACTCAACTGTCCCC : 120
LpMDHf2 : AAGAGCTGTCCTAATGCAATAGTGAATTTGATCAGCAACCCTGTGAACTCAACTGTCCCC : 118

*        140         *        160         *        180
LpMDHf1 : ATTGCGGCANAAGNTTTCAAGAGGGCTGGAACTTACTGCCCCAAACGTCTCCTTGGAGTG : 180
LpMDHf2 : ATTGCGGCAGAAGTTTTCAAGAGGGCTGGAACTTACTGCCCCAAACGTCTCCTTGGAGTG : 178

*        200         *        220         *        240
LpMDHf1 : ACAACTCTTGATGTAGCGAGGGCTAACACCTTTGTGGCTGAAGTGCTTGNAGNTGATCCT : 240
LpMDHf2 : ACAACTCTTGATGTAGCGAGGGCTAACACCTTTGTGGCTGAAGTGCTTGGAGTTGATCCT : 238

*        260         *        280         *        300
LpMDHf1 : AGAGAAGNCAGTGTTCCGGNTGTTGGCGGGCATGCNGGGATCACTATATTGCCCCTCCTG : 300
LpMDHf2 : AGAGAAGTCAGTGTTCCGGTTGTTGGCGGGCATGCAGGGATCACTATATTGCCCCTCCTG : 298

*        320         *        340         *        360
LpMDHf1 : NCCCAGGTCAGCCCCCCGTGCTCATTCACTCCAGATGAAATCAGCTATTTGACTAACCGC : 360
LpMDHf2 : TCCCAGGTCAGCCCCCCGTGCTCATTCACTCCAGATGAAATCAGCTATTTGACTAACCGC : 358

*        380         *        400         *        420
LpMDHf1 : ATACAGAATGGCGGTACCGAAGTTGTTGAGGCAAAGGCTGGAGCAGGCTCTGCAACTTTG : 420
LpMDHf2 : ATACAGAATGGCGGTACCGAAGTTGTTGAGGCAAAGGCTGGAGCAGGCTCTGCAACTTTG : 418

*        440         *        460         *        480
LpMDHf1 : TCAATGGCTTTTGCTGCTGCAAAATTCGCCCGATGCATGCTTGCGTGGAATGCGTGGTGAT : 480
LpMDHf2 : TCAATGGCTTTTGCTGCTGCAAAATTCGCCGATGCATGCTTGCGTGGAATGCGTGGTGAT : 478

*        500         *        520         *        540
LpMDHf1 : GCTGGCATTGTGGAATGTTCATACGTTGCATCTGAGGTGACAGAGCTGCCGTTCTTTGCA : 540
LpMDHf2 : GCTGGNATTGTGGAATGTN----------------------------------------- : 497

*        560         *        580         *        600
LpMDHf1 : ACAAAAGTGAGGTTAGGTCGTGGCGGAGCTGAGGAGATCCTCCCTCTTGGGCCACTGAAT : 600
LpMDHf2 : ------------------------------------------------------------ :   -

*        620         *        640         *        660
LpMDHf1 : GACTTTGAGAGAGCTGGCCTGGAGAAGGCGAANAAGGAGCTCAGCGAGAGCATCCAGAAG : 660
LpMDHf2 : ------------------------------------------------------------ :   -
```

FIGURE 5

```
                    *         680         *         700         *         720
LpMDHf1  : GGTGTGGCGTTCATGAACAAGTGAGATCATATGAATGGATGGATACCCCGCAACCTATAC : 720
LpMDHf2  : ------------------------------------------------------------ :   -

*         740         *         760         *         780
LpMDHf1  : ATAGATGATGCAAAGACTAAAGAAAGAGTGTGATATAGTGCTCCTATATACCTGTAAAAT : 780
LpMDHf2  : ------------------------------------------------------------ :   -

*
LpMDHf1  : CTCTCCTGCCTGTAAGAA : 798
LpMDHf2  : ------------------ :   -
```

FIGURE 5 (cont.)

```
              *        20         *        40         *        60
LpMDHh1   : TNACGGAGCTGCTTAAATCAGCCCCCATTCCGCCTCGTCT-C-ACTATCCTTCATCCCGTTG :  60
LpMDHh2   : ----------------------------CCGNTTACCTCT-NCNAN-CC-CGTCNCGTT-   :  29
LpMDHh3   : -----------------------------------GNCTAT-CCTNTGNTACA-CGNTGTN  :  24
LpMDHh4   : -------------------------------------GTTTACCGTTNCTAC--CNNTGTN  :  22
LpMDHh5   : ---------------------------------------GNTACCTTNCTNCCCGTTG     :  20
LpMDHh6   : ----------------------------------------GNNTCCTTNCTCCCGTTG     :  19
LpMDHh7   : -----------------------------------------GCTTT-CCTTATCCCGTTG   :  18
LpMDHh8   : -----------------------------------------GCTATCCTTCATCCCGTTG   :  19
LpMDHh9   : -----------------------------------------GCTATCCTTCATCCCGTTG   :  19
LpMDHh10  : ------------------------------------------NTACCTTNCTNCCCGTTG   :  18
LpMDHh11  : ------------------------------------------GNNTACCTTCTCTCCCCTG  :  18
LpMDHh12  : ------------------------------------------CTATCCTT-ATCCCGTTG   :  17
LpMDHh13  : -------------------------------------------GATCCTT-ATCCCGTTG   :  16
LpMDHh14  : -------------------------------------------GNNACCTTCTCCCGTTG   :  17
LpMDHh15  : -------------------------------------------GATCCTTCATCCCGTTG   :  17
LpMDHh16  : -------------------------------------------GNTCCTTCATCCCGTTG   :  17
LpMDHh17  : -------------------------------------------GATCCTT-ATCCCGTTG   :  16
LpMDHh18  : -------------------------------------------GNTCCGTCATCCCGTTG   :  17
LpMDHh19  : -------------------------------------------GNNCCTTCATCCCGTTG   :  17
LpMDHh20  : -------------------------------------------GTTCCTT-NTCCCGTTG   :  16
LpMDHh21  : -------------------------------------------GNTCCTTCATCCCGTTG   :  17
LpMDHh22  : -------------------------------------------GATCCTTCATCCCGTTG   :  17
LpMDHh23  : --------------------------------------------GNCCTTNATCCCNTTG   :  16
LpMDHh24  : --------------------------------------------GNTCNTNATCCCGTTG   :  16
LpMDHh25  : --------------------------------------------TTCCTTNCTCCCGTTG   :  16
LpMDHh26  : ---------------------------------------------TCCTTNATCCCGTTG   :  15
LpMDHh27  : ---------------------------------------------ACCTTCTNCCCGTTG   :  15
LpMDHh28  : ----------------------------------------------TCCTT-NTCCCGTTG  :  14
LpMDHh29  : ----------------------------------------------TCCTT-ATCCCGTTG  :  14
LpMDHh30  : ----------------------------------------------TCCTTCNTCCCGTTG  :  15
LpMDHh31  : -----------------------------------------------CCTTCATCCCGTTG  :  14
LpMDHh32  : -----------------------------------------------NCCTNCTNCCNTTG  :  14
LpMDHh34  : -----------------------------------------------ACCTTATCCCGTTG  :  14
LpMDHh35  : ------------------------------------------------CTTNCTCCCGTTG  :  13
LpMDHh36  : ------------------------------------------------TTNCTNCCGNCTG  :  13
LpMDHh37  : ------------------------------------------------TTNCTNCCCCCNG  :  13
LpMDHh38  : ------------------------------------------------NTTCATCCCGTTG  :  13
LpMDHh39  : -------------------------------------------------TTCATCCCNTTG  :  12
LpMDHh40  : -------------------------------------------------TTGATCCCGTTG  :  12
LpMDHh41  : -------------------------------------------------NTNATCCCCCTG  :  12
LpMDHh42  : -------------------------------------------------NTNATCCCGTTG  :  12
LpMDHh43  : -------------------------------------------------CTCNTCCCGTTG  :  12
LpMDHh44  : --------------------------------------------------TT-NTCCCGTTG :  11
LpMDHh45  : --------------------------------------------------TNCTCCCGTTG  :  11
LpMDHh46  : --------------------------------------------------TNCTCCCGTTG  :  11
LpMDHh47  : -----------------------------------------------------TCCCGTTG  :   8
LpMDHh48  : --------------------------------------------------------CC-TTG :   5
LpMDHh49  : ---------------------------------------------------------CCGTTG :  6
LpMDHh50  : ----------------------------------------------------------- :   -
LpMDHh51  : ----------------------------------------------------------- :   -
LpMDHh52  : ----------------------------------------------------------- :   -
LpMDHh53  : ----------------------------------------------------------- :   -
LpMDHh54  : ----------------------------------------------------------- :   -
LpMDHh55  : ----------------------------------------------------------- :   -
LpMDHh56  : ----------------------------------------------------------- :   -
LpMDHh57  : ----------------------------------------------------------- :   -
LpMDHh58  : ----------------------------------------------------------- :   -
LpMDHh59  : ----------------------------------------------------------- :   -
LpMDHh60  : ----------------------------------------------------------- :   -
LpMDHh61  : ----------------------------------------------------------- :   -
LpMDHh62  : ----------------------------------------------------------- :   -
LpMDHh63  : ----------------------------------------------------------- :   -
LpMDHh64  : ----------------------------------------------------------- :   -
```

```
              *         140         *         160         *         180
LpMDHh1   : CGAAGGAACCGATGCGCGTGCTCGTCACCGGCGCCGCAGGACAAATTGGATATGCTCTTGTT : 184
LpMDHh2   : CGAAGGAACCGATGCGCGTGCTCGTCACCGGCGCCGTAGGACAAATTGGATATGCTCTTGTT : 150
LpMDHh3   : CGAAGGAACCGATGCGCGTGCTCGTCACCGGCGCCGCAGGACAAATTGGATATGCTCTTGTT : 148
LpMDHh4   : CGAAGGAACCGATGCGCGTGCTCGTCACCGGCGCCGCAGGACAAATTGGATATGCTCTTGTT : 145
LpMDHh5   : CGAAGNAACCGATGCGCGTGCTCGTCACCGGCGCCGCAGGACAAATTGGATATGCTCTTGTT : 144
LpMDHh6   : CGAAGGAACCGATGCGCGTGCTCGTCACCGGCGCCGCAGGACAAATTGGATATGCTCTTGTT : 142
LpMDHh7   : CGAAGGAACCGATGCGCGTGCTCGTCACCGGCGCCGCAGGACAAATTGGATATGCTCTTGTT : 140
LpMDHh8   : CGAAGGAACCGATGCGCGTGCTCGTCACCGGCGCCGCAGGACAAATTGGATATGCTCTTGTT : 143
LpMDHh9   : CGAAGGAACCGATGCGCGTGCTCGTCACCGGCGCCGCAGGACAAATTGGATATGCTCTTGTT : 143
LpMDHh10  : CGAAGGAACCGATGCGCGTGCTCGTCACCGGCGCCGCAGGACAAATTGGATATGCTCTTGTT : 141
LpMDHh11  : CGAAGGAACCGATGCGCGTGCTCGTCACCGGCGCCGCAGGACAAATTGGATATGCTCTTGTT : 142
LpMDHh12  : CGAAGGAACCGATGCGCGTGCTCGTCACCGGCGCCGCAGGACAAATTGGATATGCTCTTGTT : 140
LpMDHh13  : CGAAGGAACCGATGCGCGTGCTCGTCACCGGCGCCGCAGGACAAATTGGATATGCTCTTGTT : 139
LpMDHh14  : CGAAGGAACCGATGCGCGTGCTCGTCACCGGCGCCGCAGGACAAATTGGATATGCTCTTGTT : 140
LpMDHh15  : CGAAGGAACCGATGCGCGTGCTCGTCACCGGCGCCGCAGGACAAATTGGATATGCTCTTGTT : 140
LpMDHh16  : CGAAGGAACCGATGCGCGTGCTCGTCACCGGCGCCGCAGGACAAATTGGATATGCTCTTGTT : 140
LpMDHh17  : CGAAGGAACCGATGCGCGTGCTCGTCACCGGCGCCGCAGGACAAATTGGATATGCTCTTGTT : 139
LpMDHh18  : CGAAGGAACCGATGCGCGTGCTCGTCACCGGCGCCGCAGGACAAATTGGATATGCTCTTGTT : 140
LpMDHh19  : CGAAGGAACCGATGCGCGTGCTCGTCACCGGCGCCGCAGGACAAATTGGATATGCTCTTGTT : 140
LpMDHh20  : CGAAGGAACCGATGCGCGTGCTCGTCACCGGCGCCGCAGGACAAATTGGATATGCTCTTGTT : 139
LpMDHh21  : CGAAGGAACCGATGCGCGTGCTCGTCACCGGCGCCGCAGGACAAATTGGATATGCTCTTGTT : 140
LpMDHh22  : CGAAGGAACCGATGCGCGTGCTCGTCACCGGCGCCGCAGGACAAATTGGATATGCTCTTGTT : 140
LpMDHh23  : CCAAGGAACCGATGCGCGTGCTCGTCACCGGCGCCGCAGGACAAATTGGATATGCTCTTGTT : 139
LpMDHh24  : NGAAGGAACCGATGCGCGTGCTCGTCACCGGCGCCGCAGGACAAATTGGATATGCTCTTGTT : 139
LpMDHh25  : CGAAGGAACCGATGCGCGTGCTCGTCACCGGCGCCGCAGGACAAATTGGATATGCTCTTGTT : 139
LpMDHh26  : CGAAGGAACCGATGCGCGTGCTCGTCACCGGCGCCGCAGGACAAATTGGATATGCTCTTGTT : 138
LpMDHh27  : CGAAGGAACCGATGCGCGTGCTCGTCACCGGCGCCGCAGGACAAATTGGATATGCTCTTGTT : 139
LpMDHh28  : CGAAGGAACCGATGCGCGTGCTCGTCACCGGCGCCGCAGGACAAATTGGATATGCTCTTGTT : 137
LpMDHh29  : CGAAGGAACCGATGCGCGTGCTCGTCACCGGCGCCGCAGGACAAATTGGATATGCTCTTGTT : 137
LpMDHh30  : CGAAGGAACCGATGCGCGTGCTCGTCACCGGCGCCGCAGGACAAATTGGATATGCTCTTGTT : 138
LpMDHh31  : CGAAGGAACCGATGCGCGTGCTCGTCACCGGCGCCGCAGGACAAATTGGATATGCTCTTGTT : 137
LpMDHh32  : CGAAGGAACCGATGCGCGTGCTCGTCACCGGCGCCGCAGGACANATTGGATATGCTCTTGTT : 138
LpMDHh34  : CNAAGGAACCGATGCGCGTGCTCGTCACCGGCGCCGCAGGACAAATTGGATATGCTCTTGTT : 137
LpMDHh35  : CGAAGGAACCGATGCGCGTGCTCGTCACCGGCGCCGCAGGACAAATTGGATATGCTCTTGTT : 137
LpMDHh36  : CGAAGGAACCGATGCGCGTGCTCGTCACCGGCGCCGCAGGACAAATTGGATATGCTCTTGTT : 136
LpMDHh37  : CGAAGGAACCGATGCGCGTGCTCGTCACCGGCGCCGCAGGACAAATTGGATATGCTCTTGTT : 137
LpMDHh38  : CGAAGGAACCGATGCGCGTGCTCGTCACCGGCGCCGCAGGACAAATTGGATATGCTCTTGTT : 136
LpMDHh39  : CGAAGGAACCGATGCGCGTGCTCNTCACCGGCGCCGCAGGACAAATTGGATATGCTCTTGTT : 136
LpMDHh40  : CGAAGGAACCGATGCGCGTGCTCGTCACCGGCGCCGCAGGACAAATTGGATATGCTCTTGTT : 135
LpMDHh41  : CGAAGGAACCGATGCGCGTGCTCGTCACCGGCGCCGCAGGACAAATTGGATATGCTCTTGTT : 135
LpMDHh42  : CGAAGGAACCGATGCGCGTGCTCGTCACCGGCGCCGCAGGACAAATTGGATATGCTCTTGTT : 134
LpMDHh43  : CGAAGGAACCGATGCGCGTGCTCGTCACCGGCGCCGCAGGACAAATTGGATATGCTCTTGTT : 135
LpMDHh44  : CGAAGGAACCGATGCGCGTGCTCGTCACCGGCGCCGCAGGACAAATTGGATATGCTCTTGTT : 134
LpMDHh45  : CGAAGGAACCGATGCGCGTGCTCGTCACCGGCGCCGCAGGACAAATTGGATATGCTCTTGTT : 133
LpMDHh46  : CGAAGGAACCGATGCGCGTGCTCGTCACCGGCGCCGCAGGACAAATTGGATATGCTCTTGTT : 134
LpMDHh47  : CGAAGGAACCGATGCGCGTGCTCGTCACCGGCGCCGCAGGACAAATTGGATATGCTCTTGTT : 131
LpMDHh48  : CGAAGGAACCGATGCGCGTGCTCGTCACCGGCGCCGCAGGACAAATTGGATATGCTCTTGTT : 127
LpMDHh49  : CGAAGGAACCGATGCGCGTGCTCGTCACCGGCGCCGCAGGACAAATTGGATATGCTCTTGTT : 130
LpMDHh50  : CGAAGGAACCGATGCGCGTGCTCGTCACCGGCGCCGCAGGACAAATTGGATATGCTCTTGTT : 108
LpMDHh51  : CGAAGNAACCGA-GCGCGTGCTCGTCACCGGCGCCGCAGGACAAATTGGATATGCTCTTGTT : 91
LpMDHh52  : -----CCACCGATGCNCGTGCTCGTCACCGGCGCCGCAGGNCAAATTGGATATGCTCTTGTT : 57
LpMDHh53  : ------------------------------------------------------------ : -
LpMDHh54  : ------------------------------------------------------------ : -
LpMDHh55  : ------------------------------------------------------------ : -
LpMDHh56  : ------------------------------------------------------------ : -
LpMDHh57  : ------------------------------------------------------------ : -
LpMDHh58  : ------------------------------------------------------------ : -
LpMDHh59  : ------------------------------------------------------------ : -
LpMDHh60  : ------------------------------------------------------------ : -
LpMDHh61  : ------------------------------------------------------------ : -
LpMDHh62  : ------------------------------------------------------------ : -
LpMDHh63  : ------------------------------------------------------------ : -
LpMDHh64  : ------------------------------------------------------------ : -
```

FIGURE 6 (cont.)

```
                        *        200         *        220         *        240
LpMDHh1  : CCGATGATTGCTAGGGGAATTATGCTTGGTGCGGACCAGCCTGTTATTCTGCATATGCTGGA : 246
LpMDHh2  : CCGATGATTGCTAGGGGAATTATGCTTGGTGCGGACCAGCCTGTTATTCTGCATATGCTGGA : 212
LpMDHh3  : CCGATGATTGCTAGGGGAATTATGCTTGGTGCGGACCAGCCTGTTATTCTGCATATGCTGGA : 210
LpMDHh4  : CCGATGATTGCTAGGNAATTATGCTTGGNGIGCACTAGCCTGTTATTNTGCATAT------  : 202
LpMDHh5  : CCGATGATTGCTAGGGGAATTATGCTTGGTGIGGACCAGCCTGTTATTCTGCATATGCTGGA : 206
LpMDHh6  : CCGATGATTGCTAGGGGAATTATGCTTGGTGCGGACCAGCCTGTTATTCTGCATATGCTGGA : 204
LpMDHh7  : CCGATGATTGCTAGGGGAATTATGCTTGGTGCGGACCAGCCTGTTATTCTGCATATGCTGGA : 202
LpMDHh8  : CCGATGATTGCTAGGGGAATTATGCTTGGTGCGGACCAGCCTGTTATTCTGCATATGCTGGA : 205
LpMDHh9  : CCGATGATTGCTAGGGGAATTATGCTTGGTGCGGACCAGCCTGTTATTCTGCATATGCTGGA : 205
LpMDHh10 : CCGATGATTGCTAGGGGAATTATGCTTGGTGCGGACCAGCCTGTTATTCTGCATATGCTGGA : 203
LpMDHh11 : CCGATGATTGCTAGGGGAATTATGCTTGGTGCGGACCAGCCTGTTATTCTGCATATGCTGGA : 204
LpMDHh12 : CCGATGATTGCTAGGGGAATTATGCTTGGTGCGGACCAGCCTGTTATTCTGCATATGCTGGA : 202
LpMDHh13 : CCGATGATTGCTAGGGGAATTATGCTTGGTGCGGACCAGCCTGTTATTCTGCATATGCTGGA : 201
LpMDHh14 : CCGATGATTGCTAGGGGAATTATGCTTGGTGCGGACCAGCCTGTTATTCTGCATATGCTGGA : 202
LpMDHh15 : CCGATGATTGCTAGGGGAATTATGCTTGGTGCGGACCAGCCTGTTATTCTGCATATGCTGGA : 202
LpMDHh16 : CCGATGATTGCTAGGGGAATTATGCTTGGTGCGGACCAGCCTGTTATTCTGCATATGCTGGA : 202
LpMDHh17 : CCGATGATTGCTAGGGGAATTATGCTTGGTGCGGACCAGCCTGTTATTCTGCATATGCTGGA : 201
LpMDHh18 : CCGATGATTGCTAGGGGAATTATGCTTGGTGCGGACCAGCCTGTTATTCTGCATATGCTGGA : 202
LpMDHh19 : CCGATGATTGCTAGGGGAATTATGCTTGGTGCGGACCAGCCTGTTATTCTGCATATGCTGGA : 202
LpMDHh20 : CCGATGATTGCTAGGGGAATTATGCTTGGTGCGGACCAGCCTGTTATTCTGCATATGCTGGA : 201
LpMDHh21 : CCGATGATTGCTAGGGGAATTATGCTTGGTGCGGACCAGCCTGTTATTCTGCATATGCTGGA : 202
LpMDHh22 : CCGATGATTGCTAGGGGAATTATGCTTGGTGCGGACCAGCCTGTTATTCTGCATATGCTGGA : 202
LpMDHh23 : CCGATGATTGCTANGGGAATTATGCTTGGTGCGGACCAGCCTGTTATTCTGCATATGCTGGA : 201
LpMDHh24 : CCGATGATTGCTAGGGGAATTATGCTTGGTGCGGACCAGCCTGTTATTCTGCATATGCTGGA : 201
LpMDHh25 : CCGATGATTGCTAGGGGAATTATGCTTGGTGCGGACCAGCCTGTTATTCTGCATATGCTGGA : 201
LpMDHh26 : CCGATGATTGCTAGGGGAATTATGCTTGGTGCGGACCAGCCTGTTATTCTGCATATGCTGGA : 200
LpMDHh27 : CCGATGATTGCTAGGGGAATTATGCTTGGTGCGGACCAGCCTGTTATTCTGCATATGCTGGA : 201
LpMDHh28 : CCGATGATTGCTAGGGGAATTATGCTTGGTGCGGACCAGCCTGTTATTCTGCATATGCTGGA : 199
LpMDHh29 : CCGATGATTGCTAGGGGAATTATGCTTGGTGCGGACCAGCCTGTTATTCTGCATATGCTGGA : 199
LpMDHh30 : CCGATGATTGCTAGGGGAATTATGCTTGGTGCGGACCAGCCTGTTATTCTGCATATGCTGGA : 200
LpMDHh31 : CCGATGATTGCTAGGGGAATTATGCTTGGTGCGGACCAGCCTGTTATTCTGCATATGCTGGA : 199
LpMDHh32 : CCGATGATTGCTAGGGGAATTATGCTTGGTGCGGACCAGCCTGTTATTCTGCATATGCTGGA : 200
LpMDHh34 : CCGATGATTGCTAGGGGAATTATGCTTGGTGCGGACCAGCCTGTTATTCTGCATATGCTGGA : 199
LpMDHh35 : CCGATGATTGCTAGGGGAATTATGCTTGGTGCGGACCAGCCTGTTATTCTGCATATGCTGGA : 199
LpMDHh36 : CCGATGATTGCTAGGGGAATTATGCTTGGTGCGGACCAGCCTGTTATTCTGCATATGCTGGA : 198
LpMDHh37 : CCGATGATTGCTAGGGGAATTATGCTTGGTGCGGACCAGCCTGTTATTCTGCATATGCTGGA : 199
LpMDHh38 : CCGATGATTGCTAGGGGAATTATGCTGGTGCGGACCAGCCTGTTATTCTGCATATGCTGGA  : 198
LpMDHh39 : CCGATGATTGCTANGGGAATTATGCTTGGTGCGGACCANCCTGTTATTCTGCATATGCTGGA : 198
LpMDHh40 : CCGATGATTGCTAGGGGAATTATGCTTGGTGCGGACCAGCCTGTTATTCTGCATATGCAGGA : 197
LpMDHh41 : CCGATGATTGCTAGGGGAATTATGCTTGGTGCGGACCAGCCGTTATTCTGCATATGCTGGA  : 197
LpMDHh42 : CCGATGATTGCTAGGGGAATTATGCTTGGTGCGGACCAGCCTGTTATTCTGCATATGCTGGA : 196
LpMDHh43 : CCGATGATTGCTAGGGGAATTATGCTTGGTGCGGACCAGCCTGTTATTCTGCATATGCTGGA : 197
LpMDHh44 : CCGATGATTGCTAGGGGAATTATGCTTGGTGCGGACCAGCCTGTTATTCTGCATATGCTGGA : 196
LpMDHh45 : CCGATGATTGCTAGGGGAATTATGCTTGGTGCGGACCAGCCTGTTATTCTGCATATGCTGGA : 195
LpMDHh46 : CCGATGATTGCTAGGGGAATTATGCTTGGTGCGGACCAGCCTGTTATTCTGCATATGCTGGA : 196
LpMDHh47 : CCGATGATTGCTAGGGGAATTATGCTTGGTGCGGACCAGCCTGTTATTCTGCATATGCTGGA : 193
LpMDHh48 : CCGATGATTGCTAGGGGAATTATGCTTGGTGCGGACCAGCCTGTTATTCTGCATATGCTGGA : 189
LpMDHh49 : CCGATGATTGCTAGGGGAATTATGCTTGGTGCGGACCAGCCTGTTATTCTGCATATGCTGGA : 192
LpMDHh50 : CCGATGATTGCTAGGGGAATTATGCTTGGTGCGGACCAGCCTGTTATTCTGCATATGCTGGA : 170
LpMDHh51 : CCGATGATTGCTAGGGGAATTATGCTTGGTGCGGACCAGCCTGTTATTCTGCATATGCTGGA : 153
LpMDHh52 : CCGATGATTGCTAGGGGAATTATGCTTGGTGCGGACCAGCCTGTTATTCTGCATATGCTGGA : 119
LpMDHh53 : ------------------TATGCTTGGTGCGG-CCAGCCTGTTATTCTGCATATGCTGGA   :  41
LpMDHh54 : ------------------------------------------------------------ :   -
LpMDHh55 : ------------------------------------------------------------ :   -
LpMDHh56 : ------------------------------------------------------------ :   -
LpMDHh57 : ------------------------------------------------------------ :   -
LpMDHh58 : ------------------------------------------------------------ :   -
LpMDHh59 : ------------------------------------------------------------ :   -
LpMDHh60 : ------------------------------------------------------------ :   -
LpMDHh61 : ------------------------------------------------------------ :   -
LpMDHh62 : ------------------------------------------------------------ :   -
LpMDHh63 : ------------------------------------------------------------ :   -
LpMDHh64 : ------------------------------------------------------------ :   -
```

FIGURE 6 (cont.)

|           |   | * | 260 | * | 280 | * | 300 | * |       |
|-----------|---|---|-----|---|-----|---|-----|---|-------|
| LpMDHh1   | : | TATTCCACCAGCTGCTGAAGCTCTTAATGGTGTTAAGATGGAGTTGGTTGATGCCGCATTTC | : | 308 |
| LpMDHh2   | : | TATTCCACCAGCTGCTGAAGCTCTTAATGGTGTTAAGATGGAGTTGGTTGATGCCGNATTN | : | 274 |
| LpMDHh3   | : | TATTCCACCAGCTGCTGAAGCTCTTAATGGCGTTAACATGGAACTGNNT-NGGCGGCNTAGN | : | 271 |
| LpMDHh4   | : | ------------------------------------------------------------ | : | -   |
| LpMDHh5   | : | TATTCCACCAGCTGCTGAAGCTCTTAATGGTGTTAAGATGGAGTTGGTTGATGCCGCATTTC | : | 268 |
| LpMDHh6   | : | TATTCCACCAGCTGCTGAAGCTCTTAATGGTGTTAAGATGGAGTTGGTTGATGCCGCATTTC | : | 266 |
| LpMDHh7   | : | TATTCCACCAGCTGCTGAAGCTCTTAATGGTGTTAAGATGGAGTTGGTTGATGCCGCATTTC | : | 264 |
| LpMDHh8   | : | TATTCCACCAGCTGCTGAAGCTCTTAATGGTGTTAAGATGGAGTTGGTTGATGCCGCATTTC | : | 267 |
| LpMDHh9   | : | TATTCCACCAGCTGCTGAAGCTCTTAATGGTGTTAAGATGGAGTTGGTTGATGCCGCATTTC | : | 267 |
| LpMDHh10  | : | TATTCCACCAGCGGCTGAAGCTCTTAATGGTGTTAAGATGGAGTTGGTTGATGCCGCATTTC | : | 265 |
| LpMDHh11  | : | TATTCCACCAGCTGCTGAAGCTCTTAATGGTGTTAAGATGGAGTTGGTTGATGCCGCATTTC | : | 266 |
| LpMDHh12  | : | TATTCCACCAGCTGCTGAAGCTCTTAATGGTGTTAAGATGGAGTTGGTTGATGCCGCATTTC | : | 264 |
| LpMDHh13  | : | TATTCCACCAGCTGCTGAAGCTCTTAATGGTGTTAAGATGGAGTTGGTTGATGCCGCATTTC | : | 263 |
| LpMDHh14  | : | TATTCCACCAGCTGCTGAAGCTCTTAATGGTGTTAAGATGGAGTTGGTTGATGCCGCATTTC | : | 264 |
| LpMDHh15  | : | TATTCCACCAGCTGCTGAAGCTCTTAATGGTGTTAAGATGGAGTTGGTTGATGCCGCATTTC | : | 264 |
| LpMDHh16  | : | TATTCCACCAGCTGCTGAAGCTCTTAATGGTGTTAAGATGGAGTTGGTTGATGCCGCATTTC | : | 264 |
| LpMDHh17  | : | TATTCCACCAGCTGCTGAAGCTCTTAATGGTGTTAAGATGGAGTTGGTTGATGCCGCATTTC | : | 263 |
| LpMDHh18  | : | TATTCCACCAGCTGCTGAAGCTCTTAATGGTGTTAAGATGGAGTTGGTTGATGCCGCATTTC | : | 264 |
| LpMDHh19  | : | TATTCCACCAGCTGCTGAAGCTCTTAATGGTGTTAAGATGGAGTTGGTTGATGCCGCATTTC | : | 264 |
| LpMDHh20  | : | TATTCCACCAGCTGCTGAAGCTCTTAATGGTGTTAAGATGGAGTTGGTTGATGCCGCATTTC | : | 263 |
| LpMDHh21  | : | TATTCCACCAGCTGCTGAAGCTCTTAATGGTGTTAAGATGGAGTTGGTTGATGCCGCATTTC | : | 264 |
| LpMDHh22  | : | TATTCCACCAGCTGCTGAANCTCTTAATGGTGTTAAGATGGAGTTGGTTGATGCCGCATTTC | : | 264 |
| LpMDHh23  | : | TATTCCACCAGCTGCTGAAGCTCTTAATGGTGTTAAGATGGAGTTGGTTGATGCCNCATTTC | : | 263 |
| LpMDHh24  | : | TATTCCACCAGCTGCTGAAGCTCTTAATGGTGTTAAGATGGAGTTGGTTGATGCCGCATTTC | : | 263 |
| LpMDHh25  | : | TATTCCACCAGCTGCTGAAGCTCTTAATGGTGTTAAGATGGAGTTGGTTGATGCCGCATTTC | : | 263 |
| LpMDHh26  | : | TATTCCACCAGCTGCTGAAGCTCTTAATGGTGTTAAGATGGAGTTGGTTGATGCCGCATTTC | : | 262 |
| LpMDHh27  | : | TATTCCACCAGCTGCTGAAGCTCTTAATGGTGTTAAGATGGAGTTGGTTGATGCCGCATTTC | : | 263 |
| LpMDHh28  | : | TATTCCACCAGCTGCTGAAGCTCTTAATGGTGTTAAGATGGAGTTGGTTGATGCCGCATTTC | : | 261 |
| LpMDHh29  | : | TATTCCACCAGCTGCTGAAGCTCTTAATGGTGTTAAGATGGAGTTGGTTGATGCCGCATTTC | : | 261 |
| LpMDHh30  | : | TATTCCACCAGCTGCTGAAGCTCTTAATGGTGTTAAGATGGAGTTGGTTGATGCCGCATTTC | : | 262 |
| LpMDHh31  | : | TATTCCACCAGCTGCTGAAGCTCTTAATGGTGTTAAGATGGAGTTGGTTGATGCCGCATTTC | : | 261 |
| LpMDHh32  | : | TATTCCACCAGCTGCTGAAGCTCTTAATGGTGTTAAGATGGAGTTGGTTGATGCCGCATTTC | : | 262 |
| LpMDHh34  | : | TATTCCACCAGCTGCTGAAGCTCTTAATGGTGTTAAGATGGAGTTGGTTGATGCCGCATTTC | : | 261 |
| LpMDHh35  | : | TATTCCACCAGCTGCTGAAGCTCTTAATGGTGTTAAGATGGAGTTGGTTGATGCCGCATTTC | : | 261 |
| LpMDHh36  | : | TATTCCACCAGCTGCTGAAGCTCTTAATGGTGTTAAGATGGAGTTGGTTGATGCCGCATTTC | : | 260 |
| LpMDHh37  | : | TATTCCACCAGCTGCTGAAGCTCTTAATGGTGTTAAGATGGAGTTGGTTGATGCCGCATTTC | : | 261 |
| LpMDHh38  | : | TATTCCACCAGCTGCTGAAGCTCTTAATGGTGTTAAGATGGAGTTGGTTGATGCCGCATTTC | : | 260 |
| LpMDHh39  | : | TATTCCACCAGCTGCTGAAGCTCTTAATGGTGTTAAGATGGAGTTGGTTGATGCCGCATTTC | : | 260 |
| LpMDHh40  | : | TATTCCACCAGCTGCTGAAGCTCTTAATGGTGTTAAGATGGAGTTGNTGATGCCGCATTTC | : | 259 |
| LpMDHh41  | : | TATTCCACCAGCTGCTGAAGCTCTTAATGGTGTTAAGATGGAGTTGGTTGATGCCGCATTTC | : | 259 |
| LpMDHh42  | : | TATTCCACCAGCTGCTGAAGCTCTTAATGGTGTTAAGATGGAGTTGGTTGATGCCGCATTTC | : | 258 |
| LpMDHh43  | : | TATTCCACCAGCTGCTGAAGCTCTTAATGGTGTTAAGATGGAGTTGGTTGATGCCGCATTTC | : | 259 |
| LpMDHh44  | : | TATTCCACCAGCTGCTGAAGCTCTTAATGGTGTTAAGATGGAGTTGGTTGATGCCGCATTTC | : | 258 |
| LpMDHh45  | : | TATTCCACCAGCTGCTGAAGCTCTTAATGGTGTTAAGATGGAGTTGGTTGATGCCGCATTTC | : | 257 |
| LpMDHh46  | : | TATTCCACCAGCTGCTGAAGCTCTTAATGGTGTTAAGATGGAGTTGGTTGATGCCGCATTTC | : | 258 |
| LpMDHh47  | : | TATTCCACCAGCTGCTGAAGCTCTTAATGGTGTTAAGATGGAGTTGGTTGATGCCGCATTTC | : | 255 |
| LpMDHh48  | : | TATTCCACCAGCTGCTGAAGCTCTTAATGGTGTTAAGATGGAGTTGGTTGATGCCGCATTTC | : | 251 |
| LpMDHh49  | : | TATTCCACCAGCTGCTGAAGCTCTTAATGGTGTTAAGATGGAGTTGGTTGATGCCGCATTTC | : | 254 |
| LpMDHh50  | : | TATTCCACCAGCTGCTGAAGCTCTTAATGGTGTTAAGATGGAGTTGGTTGATGCCGCATTTC | : | 232 |
| LpMDHh51  | : | TATTCCACCAGCTGCTGAAGCTCTTAATGGTGTTAAGATGGAGTTGGTTGATGCCGCATTTC | : | 215 |
| LpMDHh52  | : | TATTCCACCAGCTGCTGAAGCTCTTAATGGTGTTAAGATGGAGTTGGTTGATGCCGCATTTC | : | 181 |
| LpMDHh53  | : | TATTCCACCAGCTGCTGAAGCTCTTAATGGTGTTAAGATGGAGTTGGTTGATGCCGCATTTC | : | 103 |
| LpMDHh54  | : | ------------------------------------------------------------ | : | -   |
| LpMDHh55  | : | ------------------------------------------------------------ | : | -   |
| LpMDHh56  | : | ------------------------------------------------------------ | : | -   |
| LpMDHh57  | : | ------------------------------------------------------------ | : | -   |
| LpMDHh58  | : | ------------------------------------------------------------ | : | -   |
| LpMDHh59  | : | ------------------------------------------------------------ | : | -   |
| LpMDHh60  | : | ------------------------------------------------------------ | : | -   |
| LpMDHh61  | : | ------------------------------------------------------------ | : | -   |
| LpMDHh62  | : | ------------------------------------------------------------ | : | -   |
| LpMDHh63  | : | ------------------------------------------------------------ | : | -   |
| LpMDHh64  | : | ------------------------------------------------------------ | : | -   |

FIGURE 6 (cont.)

|  | | 320 | * | 340 | * | 360 | * | |
|---|---|---|---|---|---|---|---|---|
| LpMDHh1 | : | CACTTCTCAAGGGAGTTGTTGCAACAACTGATGTTGTTGAGGCTTGCACTGGTGTGAATGTT | : | 370 |
| LpMDHh2 | : | CACTTTTNAAGGGAGTTGTTGCAACAACTGATGTTGTTGAGGCTTGCACTGGNGNGAATGT- | : | 335 |
| LpMDHh3 | : | NCTTTNTCGCN------------------------------------------------- | : | 282 |
| LpMDHh4 | : | ------------------------------------------------------------ | : | - |
| LpMDHh5 | : | CACTTCTCAAGGGAGTTGTTGCAACAACTGATGTTGTTGAGGCTTGCACTGGTGTGAATGTT | : | 330 |
| LpMDHh6 | : | CACTTCTCAAGGGAGTTGTTGCAACAACTGATGTTGTTGAGGCTTGCACTGGTGTGAATGTT | : | 328 |
| LpMDHh7 | : | CACTTCTCAAGGGAGTTGTTGCAACAACTGAGTTGTTGAGGCTTGCACTGGTGTGAATGTT | : | 326 |
| LpMDHh8 | : | CACTTCTCAAGGGAGTTGTTGCAACAACTGATGTTGTTGAGGCTTGCACTGGTGTGAATGTT | : | 329 |
| LpMDHh9 | : | CACTTCTCAAGGGAGTTGTTGCAACAACTGATGTTGTTGAGGCTTGCACTGGTGTGAATGTT | : | 329 |
| LpMDHh10 | : | CACTTCTCAAGGGAGTTGTTGCAACAACTGATGTTGTTGAGGCTTGCACTGGTGTGAATGTT | : | 327 |
| LpMDHh11 | : | CACTTCTCAAGGGAGTTGTTGCAACAACTGATGTTGTTGAGGCTTGCACTGGTGTGAATGTT | : | 328 |
| LpMDHh12 | : | CACTTCTCAAGGGAGTTGTTGCAACAACTGATGTTGTTGAGGCTTGCACTGGTGTGAATGTT | : | 326 |
| LpMDHh13 | : | CACTTCTCAAGGGAGTTGTTGCAACAACTGATGTTGTTGAGGCTTGCACTGGTGTGAATGTT | : | 325 |
| LpMDHh14 | : | CACTTCTCAAGGGAGTTGTTGCAACAACTGATGTTGTTGAGGCTTGCACTGGTGTGAATGTT | : | 326 |
| LpMDHh15 | : | CACTTCTCAAGGGAGTTGTTGCAACAACTGATGTTGTTGAGGCTTGCACTGGTGTGAATGTT | : | 326 |
| LpMDHh16 | : | CACTTCTCAAGGGAGTTGTTGCAACAACTGATGTTGTTGAGGCTTGCACTGGTGTGAATGTT | : | 326 |
| LpMDHh17 | : | CACTTCTCAAGGGAGTTGTTGCAACAACTGATGTTGTTGAGGCTTGCACTGGTGTGAATGTT | : | 325 |
| LpMDHh18 | : | CACTTCTCAAGGGAGTTGTTGCGACAACTGATGTTGTTGAGGCTTGCACTGGTGTGAATGTT | : | 326 |
| LpMDHh19 | : | CACTTCTCAAGGGAGTTGTTGCAACAACTGATGTTGTTGAGGCTTGCACTGGTGTGAATGTT | : | 326 |
| LpMDHh20 | : | CACTTCTCAAGGGAGTTGTTGCAACAACTGATGTTGTTGAGGCTTGCACTGGTGTGAATGTT | : | 325 |
| LpMDHh21 | : | CACTTCTCAAGGGAGTTGTTGCAACAACTGATGTTGTTGAGGCTTGCACTGGTGTGAATGTT | : | 326 |
| LpMDHh22 | : | CACTTCTCAAGGGAGTTGTTGCAACAACTGATGTTGTTGAGGCTTGCACTGGTGTGAATGTT | : | 326 |
| LpMDHh23 | : | CACTTCTCAAGGGAGTTGTTGCAACAACTGATGTTGTTNAGGCTTGCACTGG--------- | : | 315 |
| LpMDHh24 | : | CACTTNTCAAGGGAGTTGTTGCAACAACTGATGTTGTTGAGGCTTGCACTGGTGTGAATGTT | : | 325 |
| LpMDHh25 | : | CACTTCTCAAGGGAGTTGTTGCAACAACTGATGTTGTTGAGGCTTGCACTGGTGTGAATGTT | : | 325 |
| LpMDHh26 | : | CACTTCTCAAGGGAGTTGTTGCAACAACTGATGTTGTTGAGGCTTGCACTGGTGTGAATGTT | : | 324 |
| LpMDHh27 | : | CACTTCTCAAGGGAGTTGTTGCAACAACTGATGTTGTTGAGGCTTGCACTGGTGTGAATGTT | : | 325 |
| LpMDHh28 | : | CACTTCTCAAGGGAGTTGTTGCAACAACTGATGTTGTTGAGGCTTGCACTGGTGTGAATGTT | : | 323 |
| LpMDHh29 | : | CACTTCTCAAGGGAGTTGTTGCAACAACTGATGTTGTTGAGGCTTGCACTGGTGTGAATGTT | : | 323 |
| LpMDHh30 | : | CACTTCTCAAGGGAGTTGTTGCAACAACTGATGTTGTTGAGGCTTGCACTGGTGTGAATGTT | : | 324 |
| LpMDHh31 | : | CACTTCTCAAGGGAGTTGTTGCAACAACTGATGTTGTTGAGGCTTGCACTGGTGTGAATGTT | : | 323 |
| LpMDHh32 | : | CACTTCTCAAGGGAGTTGTTGCAACAACTGATGTTGTTGAGGCTTGCACTGGTGTGAATGTT | : | 324 |
| LpMDHh34 | : | CACTTCTCAAGGGAGTTGTTGCAACGACTGATGTTGTTGAGGCTTGCACTGGTGTGAATGTT | : | 323 |
| LpMDHh35 | : | CACTTCTCAAGGGAGTTGTTGCAACAACTGATGTTGTTGAGGCTTGCACTGGTGTGAATGTT | : | 323 |
| LpMDHh36 | : | CACTTCTCAAGGGAGTTGTTGCAACAACTGATGTTGTTGAGGCTTGCACTGGTGTGAATGTT | : | 322 |
| LpMDHh37 | : | CACTTCTCAAGGGAGTTGTTGCAACAACTGATGTTGTTGAGGCTTGCACTGGTGTGAATGCT | : | 323 |
| LpMDHh38 | : | CACTTCTCAAGGGAGTTGTTGCAACAACTGATGTTGTTGAGGCTTGCACTGGTGTGAATGTT | : | 322 |
| LpMDHh39 | : | CACTTCTCAAGGGAGNTGNTGCAACAACTGATGTTGNTGAGGCTNGCACTGGTGTGAATGTT | : | 322 |
| LpMDHh40 | : | CACTTNTCAAGGGAGTTGNTGCAACAACTGATGTNGTTGANCTTGCACTGGNGTGAATGTT | : | 321 |
| LpMDHh41 | : | CACTTCTCAAGGGAGTTGTTGCAACAACTGATGTTGTTGAGGCTTGCACTGGTGTGAATGTT | : | 321 |
| LpMDHh42 | : | CACTTCTCAAGGGAGTTGTTGCAACAACTGATGTTGTTGAGGCTTGCACTGGTGTGAATGTT | : | 320 |
| LpMDHh43 | : | CACTTCTCAAGGGAGTTGTTGCAACAACTGATGTTGTTGAGGCTTGCACTGGTGTGAATGTT | : | 321 |
| LpMDHh44 | : | CACTTCTCAAGGGAGTTGTTGCAACAACTGATGTTGTTGAGGCTTGCACTGGTGTGAATGTT | : | 320 |
| LpMDHh45 | : | CACTTCTCAAGGGAGTTGTTGCAACAACTGATGTTGTTGAGGCTTGCACTGGTGTGAATGTT | : | 319 |
| LpMDHh46 | : | CACTTCTCAAGGGAGTTGTTGCAACAACTGATGTTGTTGAGGCTTGCACTGGTGTGAATGTT | : | 320 |
| LpMDHh47 | : | CACTTCTCAAGGGAGTTGTTGCAACAACTGATGTTGTTGAGGCTTGCACTGGTGTGAATGTT | : | 317 |
| LpMDHh48 | : | CACTTCTCAAGGGAGTTGTTGCAACAACTGATGTTGTTGAGGCTTGCACTGGTGTGAATGTT | : | 313 |
| LpMDHh49 | : | CACTTCTCAAGGGAGTTGTTGCAACAACTGATGTTGTTGAGGCTTGCACTGGTGTGAATGTT | : | 316 |
| LpMDHh50 | : | CACTTCTCAAGGGAGTTGTTGCAACAACTGATGTTGTTGAGGCTTGCACTGGTGTGAATGTT | : | 294 |
| LpMDHh51 | : | CACTTCTCAAGGGAGTTGTTGCAACAACTGATGTTGTTGAGGCTTGCACTGGTGTGAATGTT | : | 277 |
| LpMDHh52 | : | CACTTCTCAAGGGAGTTGTTGCAACAACTGATGTTGTTGAGGCTTGCACTGGTGTGAATGTT | : | 243 |
| LpMDHh53 | : | CACTTCTCAAGGGAGTTGTTGCAACAACTGATGTTGTTGAGGCTTGCACTGGTGTGAATGTT | : | 165 |
| LpMDHh54 | : | ------------------------------------------------------------ | : | - |
| LpMDHh55 | : | ------------------------------------------------------------ | : | - |
| LpMDHh56 | : | ------------------------------------------------------------ | : | - |
| LpMDHh57 | : | ------------------------------------------------------------ | : | - |
| LpMDHh58 | : | ------------------------------------------------------------ | : | - |
| LpMDHh59 | : | ------------------------------------------------------------ | : | - |
| LpMDHh60 | : | ------------------------------------------------------------ | : | - |
| LpMDHh61 | : | ------------------------------------------------------------ | : | - |
| LpMDHh62 | : | ------------------------------------------------------------ | : | - |
| LpMDHh63 | : | ------------------------------------------------------------ | : | - |
| LpMDHh64 | : | ------------------------------------------------------------ | : | - |

FIGURE 6 (cont.)

```
              380         *         400         *         420         *
LpMDHh1   : GCGGTTATGGTTGGTGGATTCCCCAGGAAGGAGGGAATGGAAAGGAAGGATGTTATGTCTAA : 432
LpMDHh2   : ------------------------------------------------------------ :   -
LpMDHh3   : ------------------------------------------------------------ :   -
LpMDHh4   : ------------------------------------------------------------ :   -
LpMDHh5   : GCGGTTATGGTTGGTGGATTCCCCAGGAAGGAGGGAATGGAAAGGAAGGATGTTATGTCTAA : 392
LpMDHh6   : GCGGTTATGGTTGGTGGATTCCCCAGGAAGGAGGGAATGGAAAGGAAGGATGTTATGTCTAA : 390
LpMDHh7   : GCGGTTATGGTTGGTGGATTCCCCAGGAAGGAGGGAATGGAAAGGAAGGATGTTATGTCTAA : 388
LpMDHh8   : GCGGTTATGGTTGGTGGATTCCCCAGGAAGGAGGGAATGGAAAGGAAGGATGTTATGTCTAA : 391
LpMDHh9   : GCGGTTATGGTTGGTGGATTCCCCAGGAAGGAGGGAATGGAAAGGAAGGATGTTATGTCTAA : 391
LpMDHh10  : GCGGTTATGGTTGGTGGATTCCCCAGGAAGGAGGGAATGGAAAGGAAGGATGTTATGTCTAA : 389
LpMDHh11  : GCGGTTATGGTTGGTGGATTCCCCAGGAAGGAGGGAATGGAAAGGAAGGATGTTATGTCTAA : 390
LpMDHh12  : GCGGTTATGGTTGGTGGATTCCCCAGGAAGGAGGGAATGGAAAGGAAGGATGTTATGTCTAA : 388
LpMDHh13  : GCGGTTATGGTTGGTGGATTCCCCAGGAAGGAGGGAATGGAAAGGAAGGATGTTATGTCTAA : 387
LpMDHh14  : GCGGTTATGGTTGGTGGATTCCCCAGGAAGGAGGGAATGGAAAGGAAGGATGTTATGTCTAA : 388
LpMDHh15  : GCGGTTATGGTTGGTGGATTCCCCAGGAAGGAGGGAATGGAAAGGAAGGATGTTATGTCTAA : 388
LpMDHh16  : GCGGTTATGGTTGGTGGATTCCCCAGGAAGGAGGGAATGGAAAGGAAGGATGTTATGTCTAA : 388
LpMDHh17  : GCGGTTATGGTTGGTGGATTCCCCAGGAAGGAGGGAATGGAAAGGAAGGATGTTATGTCTAA : 387
LpMDHh18  : GCGGTTATGGTTGGTGGATTCCCCAGGAAGGAGGGAATGGAAAGGAAGGATGTTATGTCTAA : 388
LpMDHh19  : GCGGTTATGGTTGGTGGATTCCCCAGGAAGGAGGGAATGGAAAGGAAGGATGTTATGTCTAA : 388
LpMDHh20  : GCGGTTATGGTTGGTGGATTCCCCAGGAAGGAGGGAATGGAAAGGAAGGATGTTATGTCTAA : 387
LpMDHh21  : GCGGTTATGGTTGGTGGATTCCCCAGGAAGGAGGGAATGGAAAGGAAGGATGTTATGTCTAA : 388
LpMDHh22  : GCGGTTATGGTTGGTGGATTCCCCAGGAAGGAGGGAATGGAAAGGAAGGATGTTATGTCTAA : 388
LpMDHh23  : ------------------------------------------------------------ :   -
LpMDHh24  : GCGGTTATGGTTGGTGGATTCCCCAGGAAGGAGGGAATGGAAAGGAAGGATGTTATGTCTAA : 387
LpMDHh25  : GCGGTTATGGTTGGTGGATTCCCCAGGAAGGAGGGAATGGAAAGGAAGGATGTTATGTCTAA : 387
LpMDHh26  : GCGGTTATGGTTGGTGGATTCCCCAGGAAGGAGGGAATGGAAAGGAAGGATGTTATGTCTAA : 386
LpMDHh27  : GCGGTTATGGTTGGTGGATTCCCCAGGAAGGAGGGAATGGAAAGGAAGGATGTTATGTCTAA : 387
LpMDHh28  : GCGGTTATGGTTGGTGGATTCCCCAGGAAGGAGGGAATGGAAAGGAAGGATGTTATGTCTAA : 385
LpMDHh29  : GCGGTTATGGTTGGTGGATTCCCCAGGAAGGAGGGAATGGAAAGGAAGGATGTTATGTCTAA : 385
LpMDHh30  : GCGGTTATGGTTGGTGGATTCCCCAGGAAGGAGGGAATGGAAAGGAAGGATGTTATGTCTAA : 386
LpMDHh31  : GCGGTTATGGTTGGTGGATTCCCCAGGAAGGAGGGAATGGAAAGGAAGGATGTTATGTCTAA : 385
LpMDHh32  : GCGGTTATGGNTGGTGGATTCCCCAGGAAGGAGGGAATGGAAAGGAAGGATGTTATGTCTAA : 386
LpMDHh34  : GCGGTTATGGTTGGTGGATTCCCCAGGAAGGAGGGAATGGAAAGGAAGGATGTTATGTCTAA : 385
LpMDHh35  : GCGGTTATGGTTGGTGGATTCCCCAGGAAGGAGGGAATGGAAAGGAAGGATGTTATGTCTAA : 385
LpMDHh36  : GCGGTTATGGTTGGTGGATTCCCCAGGAAGGAGGGAATGGAAAGGAAGGATGTTATGTCTAA : 384
LpMDHh37  : GCGGTTATGGTTGGTGGATTCCCCAGGAAGGAGGGAATGGAAAGGAAGGATGTTATGTCTAA : 385
LpMDHh38  : GCGGTTATGGTTGGTGGATTCCCCAGGAAGGAGGGAATGGAAAGGAAGGATGTTATGTCTAA : 384
LpMDHh39  : GCGGTTATGGATGGTGGAT----------------------------------------- : 341
LpMDHh40  : GCGGNNNTGNCNNGCCCANGTAANATNN-------------------------------- : 349
LpMDHh41  : GCGGTTATGGTTGGTGGATTCCCCAGGAAGGAGGGAATGGAAAGGAAGGATGTTATGTCTAA : 383
LpMDHh42  : GCGGTTATGGTTGGTGGATTCCCCAGGAAGGAGGGAATGGAAAGGAAGGATGTTATGTCTAA : 382
LpMDHh43  : GCGGTTATGGTTGGTGGATTCCCCAGGAAGGAGGGAATGGAAAGGAAGGATGTTATGTCTAA : 383
LpMDHh44  : GCGGTTATGGTTGGTGGATTCCCCAGGAAGGAGGGAATGGAAAGGAAGGATGTTATGTCTAA : 382
LpMDHh45  : GCGGTTATGGTTGGTGGATTCCCCAGGAAGGAGGGAATGGAAAGGAAGGATGTTATGTCTAA : 381
LpMDHh46  : GCGGTTATGGTTGGTGGATTCCCCAGGAAGGAGGGAATGGAAAGGAAGGATGTTATGTCTAA : 382
LpMDHh47  : GCGGTTATGGTTGGTGGATTCCCCAGGAAGGAGGGAATGGAAAGGAAGGATGTTATGTCTAA : 379
LpMDHh48  : GCGGTTATGGTTGGTGGATTCCCCAGGAAGGAGGGAATGGAAAGGAAGGATGTTATGTCTAA : 375
LpMDHh49  : GCGGTTATGGTTGGTGGATTCCCCAGGAAGGAGGGAATGGAAAGGAAGGATGTTATGTCTAA : 378
LpMDHh50  : GCGGTTATGGTTGGTGGATCCCCAGGAAGGAGGGAATGGAAAGGAAGGATGTTATGTCTAA : 356
LpMDHh51  : GCGGTTATGGTTGGTGGATTCCCCAGGAAGGAGGGAATGGAAAGGAAGGATGTTATGTCTAA : 339
LpMDHh52  : GCGGTTATGGTTGGTGGATTCCCCAGGAAGGAGGGAATGGAAAGGAAGGATGTTATGTCTAA : 305
LpMDHh53  : GCGGTTATGGTTGGTGGATTCCCCAGGAAGGAGGGATGGAAAGGAAGGATGTTATGTCTAA : 227
LpMDHh54  : ------TNGGTTGGTGGATTCCCCAGGAAGGAGGGAATGGAAAGGAAGGATGTTATGTCTAA :  56
LpMDHh55  : ------------------------------------------------------------ :   -
LpMDHh56  : ------------------------------------------------------------ :   -
LpMDHh57  : ------------------------------------------------------------ :   -
LpMDHh58  : ------------------------------------------------------------ :   -
LpMDHh59  : ------------------------------------------------------------ :   -
LpMDHh60  : ------------------------------------------------------------ :   -
LpMDHh61  : ------------------------------------------------------------ :   -
LpMDHh62  : ------------------------------------------------------------ :   -
LpMDHh63  : ------------------------------------------------------------ :   -
LpMDHh64  : ------------------------------------------------------------ :   -
```

FIGURE 6 (cont.)

```
                  440         *         460         *         480         *
LpMDHh1   : GAATGTTTCAATCTACAAATCTCAAGCATCTGCCCTTGAAGCCCATGCAGCCCCGAATTGCA : 494
LpMDHh2   : ------------------------------------------------------------ : -
LpMDHh3   : ------------------------------------------------------------ : -
LpMDHh4   : ------------------------------------------------------------ : -
LpMDHh5   : GAATGTTTCAATCTACAAATCTCAAGCATCTGCCCTTGAAGCCCATGCAGCCCCGAATTGCA : 454
LpMDHh6   : GAATGTTTCAATCTACAAATCTCAAGCATCTGCCCTTGAAGCCCATGCAGCCCCGAATTGCA : 452
LpMDHh7   : GAATGTTTCAATCTACAAATCTCAAGCATCTGCCCTTGAAGCCCATGCAGCCCNAATTGCA : 450
LpMDHh8   : GAATGTTTCAATCTACAAATCTCAAGCATCTGCCCTTGAAGCCCATGCAGCCCCGAATTGCA : 453
LpMDHh9   : GAATGTTTCAATCTACAAATCTCAAGCATCTGCCCTTGAAGCCCATGCAGCCCCGAATTGCA : 453
LpMDHh10  : GAATGTTTCAATCTACAAATCTCAAGCATCTGCCCTTGAAGCCCATGCAGCCCCGAATTGCA : 451
LpMDHh11  : GAATGTTTCAATCTACAAATCTCAAGCATCTGCCCTTGAAGCCCATGCAGCCCCGAATTGCA : 452
LpMDHh12  : GAATGTTTCAATCTACAAATCTCAAGCATCTGCCCTTGAAGCCCATGCAGCCCCGAATTGCA : 450
LpMDHh13  : GAATGTTTCAATCTACAAATCTCAAGCATCTGCCCTTGAAGCCCATGCAGCCCCGAATTGCA : 449
LpMDHh14  : GAATGTTTCAATCTACAAATCTCAAGCATCTGCCCTTGAAGCCCATGCAGCCCCGAATTGCA : 450
LpMDHh15  : GAATGTTTCAATCTACAAATCTCAAGCATCTGCCCTTGAAGCCCATGCAGCCCCGAATTGCA : 450
LpMDHh16  : GAATGTTTCAATCTACAAATCTCAAGCATCTGCCCTTGAAGCCCATGCAGCCCCGAATTGCA : 450
LpMDHh17  : GAATGTTTCAATCTACAAATCTCAAGCATCTGCCCTTGAAGCCCATGCAGCCCCGAATTGCA : 449
LpMDHh18  : GAATGTTTCAATCTACAAATCTCAAGCATCTGCCCTTGAAGCCCATGCAGCCCCGAATTGCA : 450
LpMDHh19  : GAATGTTTCAATCTACAAATCTCAAGCATCGGCCCTTGAAGCCCATGCAGCCCCGAATTGCA : 450
LpMDHh20  : GAATGTTTCAATCTACAAATCTCAAGCATCTGCCCTTGAAGCCCATGCAGCCCCGAATTGCA : 449
LpMDHh21  : GAATGTTTCAATCTACAAATCTCAAGCATCGGCCCTTGAAGCCCATGCAGCCCCGAATTGCA : 450
LpMDHh22  : GAATGTTTCAATCTACAAATCTCAAGCATCTGCCCTTGAAGCCCATGCAGCCCCGAATTGCA : 450
LpMDHh23  : ------------------------------------------------------------ : -
LpMDHh24  : GAATGTTTCAATCTACAAATCTCAAGCATCTGCCCTTGAAGCCCATGCAGCCCCGAATTGCA : 449
LpMDHh25  : GAATGTTTCAATCTACAAATCTCAAGCATCTGCCCTTGAAGCCCATGCAGCCCCGAATTGCA : 449
LpMDHh26  : GAATGTTTCAATCTACAAATCTCAAGCATCTGCCCTTGAAGCCCATGCAGCCCCGAATTGCA : 448
LpMDHh27  : GAATGTTTCAATCTACAAATCTCAAGCATCTGCCCTTGAAGCCCATGCAGCCCCGAATTGCA : 449
LpMDHh28  : GAATGTTTCAATCTACAAATCTCAAGCATCTGCCCTTGAAGCCCATGCAGCCCCGAATTGCA : 447
LpMDHh29  : GAATGTTTCAATCTACAAATCTCAAGCATCTGCCCTTGAAGCCCATGCAGCCCCGAATTGCA : 447
LpMDHh30  : GAATGTTTCAATCTACAAATCTCAAGCATCTGCCCTTGAAGCCCATGCAGCCCCGAATTGCA : 448
LpMDHh31  : NAATGTTTCAATCTACAAATCTNAAGCATCTGCCCTTGAAGCCCATGCA-CCCCNAATTGCA : 446
LpMDHh32  : NAATGTTTCAATCTACAAATCTCAAGCATCTGCCCTTGAAGCCCATGCAGCCCCGAATTGCA : 448
LpMDHh34  : GAATGTTTCAATCTACAAATCTCAAGCATCTGCCCTTGAAGCCCATGCAGCCCCGAATTGCA : 447
LpMDHh35  : GAATGTTTCAATCTACAAATCTCAAGCATCTGCCCTTGAAGCCCATGCAGCCCCGAATTGCA : 447
LpMDHh36  : GAATGTTTCAATCTACAAATCTCAAGCATCTGCCCTTGAAGCCCATGCAGCCCCGAATTGCA : 446
LpMDHh37  : GAATGTTTCAATCTACAAATCTCAAGCATCTGCCCTTGAAGCCCATGCAGCCCCGAATTGCA : 447
LpMDHh38  : GAATGTTTCAATCTACAAATCTCAAGCATCTGCCCTTGAAG-CCATGCAGCCCCGAATTGCA : 445
LpMDHh39  : ------------------------------------------------------------ : -
LpMDHh40  : ------------------------------------------------------------ : -
LpMDHh41  : GAATGTTTCAATCTACAAATCTCAAGCATCTGCCCTTGAAGCCCATGCAGCCCCGAATTGCA : 445
LpMDHh42  : GAATGTTTCAATCTACAAATCTCAAGCATCTGCCCTTGAAGCCCATGCAGCCCCGAATTGCA : 444
LpMDHh43  : GAATGTTTCAATCTACAAATCTCAAGCATCTGCCCTTGAAGCCCATGCAGCCCCGAATTGCA : 445
LpMDHh44  : GAATGTTTCAATCTACAAATCTCAAGCATCTGCCCTTGAAGCCCATGCAGCCCCGAATTGCA : 444
LpMDHh45  : GAATGTTTCAATCTACAAATCTCAAGCATCTGCCCTTGAAGCCCATGCAGCCCCGAATTGCA : 443
LpMDHh46  : GAATGTTTCAATCTACAAATCTCAAGCATCTGCCCTTGAAGCCCATGCAGCCCCGAATTGCA : 444
LpMDHh47  : AAATGTTTCAATCTACAAATCTCAAGCATCTGCCCTTGAAGCCCATGCAGCCCCGAATTGCA : 441
LpMDHh48  : GAATGTTTCAATCTACAAATCTCAAGNATCTGCCCTTGAAGCCCATGCAGCCCCGAATTGCA : 437
LpMDHh49  : GAATGTTTCAATCTACAAATCTCAAGCATCTGCCCTTGAAGCCCATGCAGCCCCGAATTGCA : 440
LpMDHh50  : GAATGTTTCAATCTACAAATCTCAAGCATCTGCCCTTGAAGCCCATGCAGCCCCGAATTGCA : 418
LpMDHh51  : GAATGTTTCAATCTACAAATCTCAAGCATCTGCCCTTGAAGCCCATGCAGCCCCGAATTGTA : 401
LpMDHh52  : GAATGTTTCAATCTACAAATCTCAAGCATCTGCCCTTGAAGCCCATGCAGCCCCGAATTGCA : 367
LpMDHh53  : GAATGTTTCAATCTACAAATCTCAAGCATCTGCCCTTGAAGCCCATGCAGCCCCGAATTGCA : 289
LpMDHh54  : GAATGTTTCAATCTACAAATCTCAAGNCNNTGCCCTTGAAGCCCATGCAGCCCCGAATTGCA : 118
LpMDHh55  : -------------------------AAGCATCTGCCCTTGAAGCCCATGCAGCCCCGAATTGCA : 40
LpMDHh56  : ----------------------------------CCATGCAA-CCCCGNANTGCA : 20
LpMDHh57  : ---------------------------------------TGCAGCCCCG-ATTGCA : 16
LpMDHh58  : ------------------------------------------------------------ : -
LpMDHh59  : ------------------------------------------------------------ : -
LpMDHh60  : ------------------------------------------------------------ : -
LpMDHh61  : ------------------------------------------------------------ : -
LpMDHh62  : ------------------------------------------------------------ : -
LpMDHh63  : ------------------------------------------------------------ : -
LpMDHh64  : ------------------------------------------------------------ : -
```

FIGURE 6 (cont.)

```
           500         *        520         *        540         *        5
LpMDHh1  : AGGTTCTGGTTGTTGCCAATCCAGCAAACACCAATGCTCTTATCTTAAAGGAGTTTGCTCCA : 556
LpMDHh2  : ------------------------------------------------------------ : -
LpMDHh3  : ------------------------------------------------------------ : -
LpMDHh4  : ------------------------------------------------------------ : -
LpMDHh5  : AGGTTCTGGTTGTTGCCAATCCAGCAAACACCAATGCTCTTATCTTAAAGGAGTTTGCTCCA : 516
LpMDHh6  : AGGTTCTGGTTGTTGCCAATCCAGCAAACACCAATGCTCTTATCTTAAAGGAGTTTGCTCCA : 514
LpMDHh7  : AGGTTCTGGTTGTTGCCAATCCAGCAAACACCAATGCTCTTATCTTAAAGGAGTTTGCTCCA : 512
LpMDHh8  : AGGTTCTGGTTGTTGCCAATCCAGCAAACACCAATGCTCTTATCTTAAAGGAGTTTGCTCCA : 515
LpMDHh9  : AGGTTCTGGTTGTTGCCAATCCAGCAAACACCAATGCTCTTATCTTAAAGGAGTTTGCTCCA : 515
LpMDHh10 : AGGTTCTGGTTGTTGCCAATCCAGCAAACACCAATGCTCTTATCTTAAAGGAGTTTGCTCCA : 513
LpMDHh11 : AGGTTCTGGTTGTTGCCAATCCAGCAAACACCAATGCTCTTATCTTAAAGGAGTTTGCTCCA : 514
LpMDHh12 : AGGTTCTGGTTGTTGCCAATCCAGCAAACACCAATGCTCTTATCTTAAAGGAGTTTGCTCCA : 512
LpMDHh13 : AGGTTCTGGTTGTTGCCAATCCAGCAAACACCAATGCTCTTATCTTAAAGGAGTTTGCTCCA : 511
LpMDHh14 : AGGTTCTGGTTGTTGCCAATCCAGCAAACACCAATGCTCTTATCTTAAAGGAGTTTGCTCCA : 512
LpMDHh15 : AGGTTCTGGTTGTTGCCAATCCAGCAAACACCAATGCTCTTATCTTAAAGGAGTTGGCTCCA : 512
LpMDHh16 : AGGTTCTGGTTGTTGCCAATCCAGCAAACACCAATGCTCTTATCTTAAAGGAGTTTGCTCCA : 512
LpMDHh17 : AGGTTCTGGTTGTTGCCAATCCAGCAAACACCAATGCTCTTATCTTAAAGGAGTTTGCTCCA : 511
LpMDHh18 : AGGTTCTGGTTGTTGCCAATCCAGNAAACACCAATGCTCTTATCNTAAAGGAGTTTGCTCCA : 512
LpMDHh19 : AGGTTCTGGTTGTTGCCAATCCAGCAAACACCAATGCTCTTATCTTAAAGGAGTTTGCTCCA : 512
LpMDHh20 : AGGTTCTGGTTGTTGCCAATCCAGCAAACACCAATGCTCTTATCTTAAAGGAGTTTGCTCCA : 511
LpMDHh21 : AGGTTCTGGTTGTTGCCAATCCAGCAAACACCAATGCTNTTATCTTAAAGGAGTTTGCTCCA : 512
LpMDHh22 : AGGTTCTGGTTGTTGCCAATCCAGCAAACACCAATGCTCTTATCTTAAAGGAGTTTGCTCCA : 512
LpMDHh23 : ------------------------------------------------------------ : -
LpMDHh24 : AGGTTCTGGTTGTTGCCAATCCAGCAAACACCAATGCTCTTATNTTAAAGGAGTTTGCTCCA : 511
LpMDHh25 : AGGTTCTGGTTGTTGCCAATCCAGCAAACACCAATGCTCTTATCTTAAAGGAGTTTGCTCCA : 511
LpMDHh26 : AGGTTCTGGTTGTTGCCAATCCAGCAAACACCAATGCTCTTATCTTAAAGGAGTTTGCTCCA : 510
LpMDHh27 : AGGTTCTGGTTGTTGCCAATCCAGCAAACACCAATGCTCTTATCTTAAAGGAGTTTGCTCCA : 511
LpMDHh28 : AGGTTCTGGTTGTTGCCAATCCAGCAAACACCAATGCTCTTATCTTAAAGGAGTTTGCTCCA : 509
LpMDHh29 : AGGTTCTGGTTGTTGCCAATCCAGCAAACACCAATGCTCTTATCTTAAAGGAGTTTGCTCCA : 509
LpMDHh30 : AGGTTCTGGTTGTTGCCAATCCAGCAAACACCAATGCTCTTATCTTAAAGGAGTTTGCTCCA : 510
LpMDHh31 : AGGNTCTGGTTGTTGCCAATCCAGCAAACACCAATGCTNTTATNTTAAANGAGTTTGCTCCA : 508
LpMDHh32 : AGGTTCTGGTTGTTGCCAATCCAGCAAACACCANTGCTCTTATCTTAAAGGAGTTTGCTCCA : 510
LpMDHh34 : AGGTTCTGGTTGTTGCCAATCCAGCAAACACCAATGCTCTTATCTTAAAGGAGTTTGCTCCA : 509
LpMDHh35 : AGGTTCTGGTTGTTGCCAATCCA------------------------------------- : 470
LpMDHh36 : AGGTTCTGGTTGTTGCCAATCCAGCAAACACCAATGCTCTTATCTTAAAGGAGTTTGCTCCA : 508
LpMDHh37 : AGGTTCTGGTTGTTGCCAATCCAGCAAACACCAATGCTCTTATCTTAAAGGAGTTTGCTCCA : 509
LpMDHh38 : AGGTTCTGGTTGTTGCCAATCCAGCAAACACCAATGCTCTTATCTTAAAGGAGTTTGCTCCA : 507
LpMDHh39 : ------------------------------------------------------------ : -
LpMDHh40 : ------------------------------------------------------------ : -
LpMDHh41 : AGGTTCTGGTTGTTGCCAATCCAGCAAACACCAATGCTCTTATCTTAAAGGAGNTTGCTCCA : 507
LpMDHh42 : AGGTTCTGGTTGTTGCCAATCCAGCAAACACCAATGCTCTTATCTTAAAGGAGTTTGCTCCA : 506
LpMDHh43 : AGGTTCTGGTTGTTGCCAATCCAGCAAACACCAATGCTCTCTTATCTTAAAGGAGTTTGCTCCA : 507
LpMDHh44 : AGGTTCTGGTTGTTGCCAATCCAGCAAACACCAATGCTCTTATCTTAAAGGAGTTTGCTCCA : 506
LpMDHh45 : AGGTTCTGGTTGTTGCCAATCCAGCAAACACCAATGCTCTTATCTTAAAGGAGTTTGCTCCA : 505
LpMDHh46 : AGGTTCTGGTTGTTGCCAATCCAGCAAACACCAATGCTCTTATCTTAAAGGAGTTTGCTCCA : 506
LpMDHh47 : AGGTTCTGGTTGTTGCCAATCCAGCAAACACCAATGCTNTTATCTTAAAGGAGTTTGCTCCA : 503
LpMDHh48 : AGGTTCTGGTTGTTGCCAATCCAGCAAACACCAATGCTCTTATCTTAAAGGAGTTTGCTCCA : 499
LpMDHh49 : AGGTTCTGGTTGTTGCCAATCCAGCAAACACCAATGCTCTTATCTTAAAGGAGTTTGCTCCA : 502
LpMDHh50 : AGGTTCTGGTTGTTGCCAATCCAGCAAACACCAATGCTCTTATCTTAAAGGAGTTTGCTCCA : 480
LpMDHh51 : AGGTTCTGGTTGTTGCCAATCCAGCAAACACCAATGCTCTTATCTTAAAGGAGTTTGCTCCA : 463
LpMDHh52 : AGGTTCTGGTTGTTGCCAATCCAGCAAACACCAATGCTCTTATCTTAAAGGAGTTTGCTCCA : 429
LpMDHh53 : AGGTTCTGGTTGTTGCCAATCCAGCAAACACCAATGCTCTTATCTTAAAGGAGTTTGCTCCA : 351
LpMDHh54 : AGGTTCTGGTTGTTGCCAATCCAGCAAACACCAATGCTCTTATCTTAAAGGAGTTTGCTCCA : 180
LpMDHh55 : AGGTTCTGGTTGTTGCCAATCCAGCAAACACCAATGCTCTTATCTTAAAGGAGTTTGCTCCA : 102
LpMDHh56 : AGGTTCTGGTTGTTGCCAATCCAGCAAACACCAATGCTCTTATCTTAAAGGAGTTTGCTCCA : 82
LpMDHh57 : AGGTTCTGGTTGTTGCCAATCCAGCAAACACCAATGCTCTTATCTTAAAGGAGTTTGCTCCA : 78
LpMDHh58 : ------------------------------------------------------------ : -
LpMDHh59 : ------------------------------------------------------------ : -
LpMDHh60 : ------------------------------------------------------------ : -
LpMDHh61 : ------------------------------------------------------------ : -
LpMDHh62 : ------------------------------------------------------------ : -
LpMDHh63 : ------------------------------------------------------------ : -
LpMDHh64 : ------------------------------------------------------------ : -
```

FIGURE 6 (cont.)

```
                      60        *        580        *        600        *        620
LpMDHh1   : TCTATTCCTGAGAAGAACATCAGTTGTTTGACCCGCCTAGACCATAACAGGGCACTTGGTCA : 618
LpMDHh2   : ------------------------------------------------------------ : -
LpMDHh3   : ------------------------------------------------------------ : -
LpMDHh4   : ------------------------------------------------------------ : -
LpMDHh5   : TCTATTCCTGAGAAGAACATCAGTTGTTTGACCCGCCTAGACCATAACAGGGCACTTGGTCA : 578
LpMDHh6   : TCTATTCCTGAGAAGAACATCAGTTGTTTGACCCGCCTAGACCATAACAGGGCACTTGGTCA : 576
LpMDHh7   : TCTATTCCTGANAAGAACATNAGTTGTTTGACCCGCCTAGACCATAACAGGGCACTNGGTCA : 574
LpMDHh8   : TCTATTCCTGAGAAGAACATCAGTTGTTTGACCCGCCTAGACCATAACAGGGCACTTGGTCA : 577
LpMDHh9   : TCTATTCCTGAGAAGAACATCAGTTGTTTGACCCGCCTAGACCATAACAGGGCACTTGGTCA : 577
LpMDHh10  : TCTATTCCTGAGAAGAACATCAGTTGTTTGACCCGCCTAGACCATAACAGGGCACTTGGTCA : 575
LpMDHh11  : TCTATTCCTGAGAAGAACATCAGTTGTTTGACCCGCCTAGACCATAACAGGGCACTTGGTCA : 576
LpMDHh12  : TCTATTCCTGAGAAGAACATCAGTTGTTTGACCCGCCTAGACCATAACAGGGCACTTGGTCA : 574
LpMDHh13  : TCTATTCCTGAGAAGAACATCAGTTGTTTGACCCGCCTAGACCATAACAGGC---------- : 563
LpMDHh14  : TCTATTCCTGAGAAGAACATCAGTTGTTTGACCCGCCTAGACCATAACAGGGCACTGGTCA  : 574
LpMDHh15  : TCTATTCCTGAGAAGAACATCAGTTGTTTGACCCGCCTAGACCATAACAGGGCACTTGGTCA : 574
LpMDHh16  : TCTATTCCTGAGAAGAACATCAGTTGTTTGACCCGCCTAGACCATAACAGGGCACTGGTCA  : 574
LpMDHh17  : TCTATTCCTGAGAAGAACATCAGTTGTTTGACCCGCCTAGACCATAACAGGGCACTTGGTCA : 573
LpMDHh18  : TCTATTCCTGAGAAGAACATCAGTTGTTTGACCCGCCTAGACCATAACAGGGCACTGGTCA  : 574
LpMDHh19  : TCTATTCCTGAGAAGAACATCAGTTGTTTGACCCGCCTAGACCATAACAGGGCACTTGGTCA : 574
LpMDHh20  : TCTATTCCTGAGAAGAACATCAGTTGTTTGACCCGCCTAGACCATAACAGGGCACTGGTCA  : 573
LpMDHh21  : TCTATTCCTGAGAAGAACATCAGTTGTTTGACCCGCCTAGACCATAACAGGGCACTTGGTCA : 574
LpMDHh22  : TCTATTCCTGAGAAGAACATCAGTTGTTTGACCCGCCTAGACCATAACAGGGCACTTGGTCA : 574
LpMDHh23  : ------------------------------------------------------------ : -
LpMDHh24  : TCTNTTCCTGAGAA---------------------------------------------- : 525
LpMDHh25  : TCTATTCCTGAGAAGAACATCAGATGTTTGACCCGNCTAGACCATAACAGGGCACTGGTCA  : 573
LpMDHh26  : TCTATTCCTGAGAAGAACATCAGTTGTTTGACCCGCCTAGACCATAACAGGGCACTTGGTCA : 572
LpMDHh27  : TCTATTCCTGAGAAGAACATCAGTTGTTTGACCCGCCTAGACCATAACAGGGCACTGGTCA  : 573
LpMDHh28  : TCTATTCCTGAGAAGAACATCAGTTGTTTGACCCGCCTAGACCATAACAGGGCACTTGGTCA : 571
LpMDHh29  : TCTATTCCTGAGAAGAACATCAGTTGTTTGACCCGCCTAGACCATAACAGGGCACTTGGTCA : 571
LpMDHh30  : TCTATTCCTGAGAAGAACATCAGTTGTTTGACCCGCCTAGACCATAACAGGGCACTGGTCA  : 572
LpMDHh31  : NTATTCCTGANAAGAACATNATTGTTTGACCCGCCTAGACCATAACANGCNNCTTGNCAA   : 570
LpMDHh32  : TCTATCCCTGAGAAGAACATCAGTTGTTTGACCCGCCTAGACCATAACAGGGCACTTGGTCA : 572
LpMDHh34  : TCTATTCCTGAGAAGAACATCAGTTGTTTGACCCGCCTAGACCATAACAGGGCACTTGGTCA : 571
LpMDHh35  : ------------------------------------------------------------ : -
LpMDHh36  : TCTATTCCTGAGAAGAACATCAGTTGTTTGACCCGCCTAGACCATAACAGGGCACTTGGTCA : 570
LpMDHh37  : TCTATTCCTGAGAAGAACATCAGTTGTTTGACCCGNCTAGACCATAACAGGGCACTGGNCA  : 571
LpMDHh38  : TCTATTCCTGAGAAGAACATCAGTTGTTTGACCCGCCTAGACCATAACAGGGCACTTGGTCA : 569
LpMDHh39  : ------------------------------------------------------------ : -
LpMDHh40  : ------------------------------------------------------------ : -
LpMDHh41  : TCTATTCCTGAGAANAACATCAGNTGTTTGACCCGCCTAGACCATAACAGGNCACTGGNCA  : 569
LpMDHh42  : TCTATTCCTGAGAAGAACATCAGTTGTTTGACCCGCCTAGACCATAACAGGGCACTTGGTCA : 568
LpMDHh43  : TCTATTCCTGAGAAGAACATCAGTTGTTTGACCCGCCTAGACCATAACAGGGCACTTGGTCA : 569
LpMDHh44  : TCTATTCCTGAGAAGAACATCAGTTGTTTGACCCGCCTAGACCATAACAGGGCACTTGGTCA : 568
LpMDHh45  : TCTATTCCTGAGAAGAACATCAGTTGTTTGACCCGCCTAGACCATAACAGGGCACTGGTCA  : 567
LpMDHh46  : TCTATTCCTGAGAAGAACATCAGTTGTTTGACCCGCCTAGACCATAACAGGGCACTGGTCA  : 568
LpMDHh47  : TCTATTCCTGANAAGAACATNATTGTTTGACCCGCCTAGACCATAACAGGGCACTTGGTCA  : 565
LpMDHh48  : TCTATTCCTGAGAAGAACATCAGTTGTTTGACCCGCCTAGACCATAACAGGGCACTTGGTCA : 561
LpMDHh49  : TCTATTCCTGAGAAGAACATCAGTTATTTGACCCGCCTAGACCATAACAGGGCACTTGGTCA : 564
LpMDHh50  : TCTATTCCTGAGAAGAACATCAGTTGTTTGACCCGCCTAGACCATAACAGGGCACTTGGTCA : 542
LpMDHh51  : TCTATTCCTGAGAAGAACATCAGTTGTTTGACCCGCCTAGACCATAACAGGGCACTGGTCA  : 525
LpMDHh52  : TCTATTCCTGAGAAGAACATCAGTTGTTTGACCCGCCTAGACCATAACAGGGCACTTGGTCA : 491
LpMDHh53  : TCTATTCCTGAGAAGAACATCAGTTGTTTGACCCGCCTAGACCATAACAGGGCACTTGGTCA : 413
LpMDHh54  : TCTATTCCTGAGAAGAACATCAGTTGTTTGACCCGCCTAGACCATAACAGGGCACTTGGTNA : 242
LpMDHh55  : TCTATTCCTGAGAAGAACATCAGTTGTTTGACCCGCCTAGACCATAACAGGGCACTGGTCA  : 164
LpMDHh56  : TCTATTCCTGAGAAGAACATCAGTTGTTTGACCCGCCTAGACCATAACAGGGCACTTGGTCA : 144
LpMDHh57  : TCTATTCCTGAGAAGAACATCAGTTGTTTGACCCGCCTAGACCATAACAGGGCACTTGGTCA : 140
LpMDHh58  : ------------------------------------------------------------ : -
LpMDHh59  : ------------------------------------------------------------ : -
LpMDHh60  : ------------------------------------------------------------ : -
LpMDHh61  : ------------------------------------------------------------ : -
LpMDHh62  : ------------------------------------------------------------ : -
LpMDHh63  : ------------------------------------------------------------ : -
LpMDHh64  : ------------------------------------------------------------ : -
```

FIGURE 6 (cont.)

```
                          *         640         *         660         *         680
LpMDHh1  : GATCTCTGAGAGACTTGATGNCCAAGTTAGTGATGTGAANAATGTTATCATCTGGGGCAATC : 680
LpMDHh2  : ------------------------------------------------------------ : -
LpMDHh3  : ------------------------------------------------------------ : -
LpMDHh4  : ------------------------------------------------------------ : -
LpMDHh5  : GATCTCTGAGAGACTTGATGCCCAAGTTAGTGATGTGAAGAATGTTATCATCTGGGGCAATC : 640
LpMDHh6  : GATCTCTGAGAGACTTGATGTCCAAGTTAGTGATGTGAAGAATGTTATCATCTGGGGCAATC : 638
LpMDHh7  : GATCTCTGAGAGACTTNATGTCCAANTTAGTGATGTGAANAATGTTATCATCTGGGGCAATC : 636
LpMDHh8  : GATCTCTGAGAGACTTGATGTCCAAGTTAGTGATGTGAAGAATGTTATCATCTGGGGCAATC : 639
LpMDHh9  : GATCTCTGAGAGACTTGATGTCCAAGTTAGTGATGTGAAGAATGTTATCATCTGGGGCAATC : 639
LpMDHh10 : GATCTCTGAGAGACTTGATGTCCAAGTTAGTGATGTGAAGAATGTTATCATCTGGGGCAATC : 637
LpMDHh11 : GATCTCTGAGAGACTTGATGTCCAAGTTAGTGATGTGAAGAATGTTATCATCTGGGGCAATC : 638
LpMDHh12 : GATCTCTGAGAGACTTGATGTCCAAGTTAGTGATGTGAAGAATGTTATCATCTGGGGCAATC : 636
LpMDHh13 : ------------------------------------------------------------ : -
LpMDHh14 : GATCTCTGAGAGACTTGATGTCCAAGTTAGTGATGTGAAGAATGTTATCATCTGGGGCAATC : 636
LpMDHh15 : GATCTCTGAGAGACTTGATGTCCAAGTTAGTGATGTGAAGAATGTTATCATCTGGGGCAATC : 636
LpMDHh16 : GATCTCTGAGAGCTTGATGTCCAAGTTAGTGATGTGAAGAATGTTATCATCTGGGGCAATC : 636
LpMDHh17 : GATCTCTGAGAGACTTGATGTCCAAGTTAGTGATGTGAAGAATGTTATCATCTGGGGCAATC : 635
LpMDHh18 : GATCTCTGAGAGACTTGATGTCCAAGTTAGTGATGTGAAGAATGTTATCATCTGGGGCAATC : 636
LpMDHh19 : GATCTCTGAGAGACTTGATGTCCAAGTTAGTGATGTGAAGAATGTTATCATCTGGGGCAATC : 636
LpMDHh20 : GATCTCTGAGAGCTTGATGTCCAAGTTAGTGATGTGAAGAATGTTATCATCTGGGGCAATC : 635
LpMDHh21 : GATCTCTGAGAGACTTGATGTCCAAGTTAGTGATGTGAAGAATGTTATCATCTGGGGCAATC : 636
LpMDHh22 : GATCTCTGAGAGACTTGATGTCCAAGTTAGTGATGTGAAGAATGTTATCATCTGGGGCAATC : 636
LpMDHh23 : ------------------------------------------------------------ : -
LpMDHh24 : ------------------------------------------------------------ : -
LpMDHh25 : GATCTCTGAGAGACTTGATGTCCAAGTTACGATGTGAAAAATGCTATCATCTGGGANATC : 635
LpMDHh26 : GATCTCTGAGAGACTTGATGTCCAAGTTAGTGATGTGAAAAATGTTATCATCTGGGGCAATC : 634
LpMDHh27 : GATCTCTGAGAGACTTGATGTCCAAGTTAGTGATGTGAAGAATGTTATCATCTGGGGCAATC : 635
LpMDHh28 : GATCTCTGAGAGACTTGATGTCCAAGTTAGTGATGTGAAGAATGTTATCATCTGGGGCAATC : 633
LpMDHh29 : GATCTCTGAGAGACTTGATGTCCAAGTTAGTGATGTGAAGAATGTTATCATCTGGGGCAATC : 633
LpMDHh30 : GATCTCTGAGAGCTTGATGTCCAAGTTAGTGATGTGAAGAATGTTATCATCTGGGGCAATC : 634
LpMDHh31 : AATCTTNANAGACTTGNTNTCAAN------------------------------------ : 595
LpMDHh32 : GATCTCTGAGAGACTTGATGTCCAAGTTAGNGATGNGAANAATGTTATCATCTGGGGCAATC : 634
LpMDHh34 : GATCTCTGAGAGACTTGATGTCCAAGTTAGTGATGTGAAGAATGTTATCATCTGGGGCAATC : 633
LpMDHh35 : ------------------------------------------------------------ : -
LpMDHh36 : GATCTCTGANAGACTTGATGTCCAAGTTA------------------------------- : 599
LpMDHh37 : GATCTCTGAGAGACTTGATGTCCAAGTTAGTGATG------------------------- : 606
LpMDHh38 : GATCTCTGAGAGACTTGATGTCCAAGTTAGTGATGTGAAGAATGTTATCATCTGGGGCAATC : 631
LpMDHh39 : ------------------------------------------------------------ : -
LpMDHh40 : ------------------------------------------------------------ : -
LpMDHh41 : GANCTCTGAGAGACNTGATGCCCAAGNTNGNGNTGN------------------------ : 605
LpMDHh42 : GATCTCTGAGAGACTTGATGTCCAAGTTAGTGATGTGAAGAATGTTATCATCTGGGCAATC : 630
LpMDHh43 : GATCTCTGAGAGACTTGATGTCCAAGTTAGTGATGTGAAGAATGTTATCATCTGGGGCAATC : 631
LpMDHh44 : GATCTCTGAGAGACTTGATGTCCAAGTTAGTGATGTGAAGAATGTTATCATCTGGGGCAATC : 630
LpMDHh45 : GATCTCTGAGAGACTTGATGTCCAAGTTAGTGATGTGAAGAATGTTATCATCTGGGGCAATC : 629
LpMDHh46 : GATCTCTGAGAGACTTGATGTCCAAGTTAGTGATGTGAAGAATGTTATCATCTGGGGCAATC : 630
LpMDHh47 : GATCTNTGANAGACTTGATGGCCAAGTTAGNGATGTGAAAAATGTTATCATNGGGGCAATN : 627
LpMDHh48 : GATCTCTGAGAGACTTGATGTCCAAGTTAGTGATGTGAAGAATGTTATCATCTGGGGCAATC : 623
LpMDHh49 : GATCTCTGAGAGACTTGATGTCCAAGTTAGTGATGTGAAGAATGTTATCATCTGGGGCAATC : 626
LpMDHh50 : GATCTCTGAGAGACTTGATGTCCAAGTTAGTGATGTGAAGAATGTTATCATCTGGGGCAATC : 604
LpMDHh51 : GATCTCTGAGAGACTTGATGTCCAAGTTAGTGATGTGAAGAATGTTATCATCTGGGGCAATC : 587
LpMDHh52 : GATCTCTGAGAGACTTGATGTCCAAGTTAGTGATGTGAAGAATGTTATCATCTGGGGCAATC : 553
LpMDHh53 : GATCTCTGAGAGACTTGATGTNCAAGTTAGTGATGTGAANAATGNTATCATCTGGNCANTC : 475
LpMDHh54 : GATCTCTGAGAGACTTGATGTCCAAGTTAGTGATGTGAAGAATGTTATCATCTGGGGCAATC : 304
LpMDHh55 : GATCTCTGAGAGACTTGATGTCCAAGTTAGTGATGTGAAGAATGTTATCATCTGGGGCAATC : 226
LpMDHh56 : GATCTCTGAGAGACTTGATGTCCAAGTTAGTGATGTGAAGAATGTTATCATCTGGGGCAATC : 206
LpMDHh57 : GATCTCTGAGAGACTTGATGTCCAAGTTAGTGATGTGAAGAATGTTATCATCTGGGGCAATC : 202
LpMDHh58 : ---------------------------------------------------GCAATC    : 6
LpMDHh59 : ------------------------------------------------------------ : -
LpMDHh60 : ------------------------------------------------------------ : -
LpMDHh61 : ------------------------------------------------------------ : -
LpMDHh62 : ------------------------------------------------------------ : -
LpMDHh63 : ------------------------------------------------------------ : -
LpMDHh64 : ------------------------------------------------------------ : -
```

```
                          *         760           *         780         *         800
LpMDHh1  : CCTGTTCGCGAACTTGTTAAAGACGATG------------------------------------- :  770
LpMDHh2  : ----------------------------------------------------------------- :    -
LpMDHh3  : ----------------------------------------------------------------- :    -
LpMDHh4  : ----------------------------------------------------------------- :    -
LpMDHh5  : ----------------------------------------------------------------- :    -
LpMDHh6  : ----------------------------------------------------------------- :    -
LpMDHh7  : ----------------------------------------------------------------- :    -
LpMDHh8  : CCTGTTCGCGAACTTGTTAAAGACGATGAATGGCTAAATGCAGGGNTCATTGCCACTGTCCA :  763
LpMDHh9  : CCTGTTCGCGAACTTGTTAAAGACGATGAATGGCTAAATGCANGGCTCATTGCCACTGTCCA :  763
LpMDHh10 : ----------------------------------------------------------------- :    -
LpMDHh11 : CCTGTTC--------------------------------------------------------- :  707
LpMDHh12 : CCTGTTCGCGAACTTGTTAAAGACGATGAATGGCTAAATGCAGGGTTCATTGCCACTGTCCA :  760
LpMDHh13 : ----------------------------------------------------------------- :    -
LpMDHh14 : ----------------------------------------------------------------- :    -
LpMDHh15 : CCTGTTCGCGAACTTGTTAAAGACGATGAATGGCTAAATGCAGGGTTCATTGCCACTGTCCA :  760
LpMDHh16 : CCTGTTCGCGAACTTGTTAAAGACGATGAATGGCTAAATGCAGGGTTCATTGCCACTGTCCA :  760
LpMDHh17 : CCTGTTCGCGAACTTGTTAAAGACGATGAATGGCTAAATGCAGGGTTCATTGCCACTGTCCA :  759
LpMDHh18 : CCTGTTCGCGAACTTGTTAAAGACGATGAATGGCTAAATGCAGGGTTCATTGCCACTGTCCA :  760
LpMDHh19 : CCTGTTCGCGAACTTGTTAAAGACGATGAATGGCTAAATGCAGGGTTCATTGCCACTGTCCA :  760
LpMDHh20 : CCTGTTCGCGAACTTGTTAAAGACGATGAATGGCTAAATGCAGGGTTCATTGCCACTGTCCA :  759
LpMDHh21 : CCTGTTCGCGAACTTGTTAAAGACGATGAATGGCTNAATGCAGGGTTCATTGCCACTGNCCA :  760
LpMDHh22 : CCTGTTCGCGAACTTGTTAAAGACGATGAATGGCTAAATGCAGGGTTCATTGCCACTGTCCA :  760
LpMDHh23 : ----------------------------------------------------------------- :    -
LpMDHh24 : ----------------------------------------------------------------- :    -
LpMDHh25 : ----------------------------------------------------------------- :    -
LpMDHh26 : ----------------------------------------------------------------- :    -
LpMDHh27 : CCTGTTCGCGAACT-------------------------------------------------- :  711
LpMDHh28 : CCTGTTCGCGAACTTGTTAAAGACGATGAATGGCTAAATGCAGGGTTCATTGCCACTGTCCA :  757
LpMDHh29 : CCTGTTCGCGAACTTGTTAAAGACGATGAATGGCTAAATGCAGGGTTCATTGCCACTGTCCA :  757
LpMDHh30 : CCTGTTCGCGAACTTGNTAAAGACGATGAATGGCTAAATGCAGGGTTCATTGCCACTGTCCA :  758
LpMDHh31 : ----------------------------------------------------------------- :    -
LpMDHh32 : ----------------------------------------------------------------- :    -
LpMDHh34 : CCTGTTCGCGAACTTGTTAAAGACGATGAATGGCTAAATGCAGGGTTCATTGCCACTGTCCA :  757
LpMDHh35 : ----------------------------------------------------------------- :    -
LpMDHh36 : ----------------------------------------------------------------- :    -
LpMDHh37 : ----------------------------------------------------------------- :    -
LpMDHh38 : ----------------------------------------------------------------- :    -
LpMDHh39 : ----------------------------------------------------------------- :    -
LpMDHh40 : ----------------------------------------------------------------- :    -
LpMDHh41 : ----------------------------------------------------------------- :    -
LpMDHh42 : ----------------------------------------------------------------- :    -
LpMDHh43 : CCTGTTCGCGAACTTGTTAAAGACGATGAATGGCTAAATGCAGGGTTCATTGCCACTGTCCA :  755
LpMDHh44 : CCTGTTCGCGAACTTGTTAAAGACGATGAATGGCTAAATGCAGGGTTCATTGCCACTGTCCA :  754
LpMDHh45 : ----------------------------------------------------------------- :    -
LpMDHh46 : CCTGTTCG-------------------------------------------------------- :  700
LpMDHh47 : ----------------------------------------------------------------- :    -
LpMDHh48 : ----------------------------------------------------------------- :    -
LpMDHh49 : CCTGTTCGCGAACTTGTTAAAGACGATGAATGGCTAAATGCAGGGTTCATTGCCACTGTCCA :  750
LpMDHh50 : CCTGTTCGCGAACTTGTTAAAGACGATGAATGGCTAAATGCAGGGTTCATTGCCACTGTCCA :  728
LpMDHh51 : CCTGTTCGCGAACTTGTTAAAGACGAT------------------------------------- :  676
LpMDHh52 : CCTGTTCGCGAACTTGTTAAAGACGATGAATGGCTAAATGCAGGGTTCATTGCCACTGTCCA :  677
LpMDHh53 : ----------------------------------------------------------------- :    -
LpMDHh54 : CCTGTTCGCGAACTTGTTAAAGACGATGAATGGCTAAATGCAGGGTTCATTGCCACTGTCCA :  428
LpMDHh55 : CCTGTTCGCGAACTTGTTAAAGACGATGAATGGCTAAATGCAGGGTTCATTGCCACTGTCCA :  350
LpMDHh56 : CCTGTTCGCGAACTTGTTAAAGACGATGAATGGCTAAATGCAGGGTTCATTGCCACTGTCCA :  330
LpMDHh57 : CCTGTTCGCGAACTTGTTAAAGACGATGAATGGCTAAATGCAGGGTTCATTGCCACTGTCCA :  326
LpMDHh58 : CCTGTTCGCGAACTTGTTAAAGACGATGAATGGCTAAATGCAGGGTTCATTGCCACTGTCCA :  129
LpMDHh59 : CCTGTTCGCGAACTTGTTAAAGACGATGAATGGCTAAATGCAGGGTTCATTGCCACTGTCCA :  111
LpMDHh60 : CCTGTTCGCG-ACTTGTTAAAGACGATGAATGGCTAAATGCAGGGTTCATTGCCACTGTCCA :   75
LpMDHh61 : CCTGTTCGCGAACTTGTTAAAGACGATGAATGGCTAAATGCAGGGTTCATTGCCACTGTCCA :   70
LpMDHh62 : ----------------------------------------------------------------- :    -
LpMDHh63 : ----------------------------------------------------------------- :    -
LpMDHh64 : ----------------------------------------------------------------- :    -
```

FIGURE 6 (cont.)

```
              *         820         *         840         *         860
LpMDHh1   : ------------------------------------------------------------ :   -
LpMDHh2   : ------------------------------------------------------------ :   -
LpMDHh3   : ------------------------------------------------------------ :   -
LpMDHh4   : ------------------------------------------------------------ :   -
LpMDHh5   : ------------------------------------------------------------ :   -
LpMDHh6   : ------------------------------------------------------------ :   -
LpMDHh7   : ------------------------------------------------------------ :   -
LpMDHh8   : GCAGCGTGGTGCTGCAATCATCAAAGCGAG------------------------------ : 793
LpMDHh9   : GCAGCGTGGNGCTGCAATCATCAAAGNGAGGAAG--------------------------- : 797
LpMDHh10  : ------------------------------------------------------------ :   -
LpMDHh11  : ------------------------------------------------------------ :   -
LpMDHh12  : GCAGCGTGGTGCTGCAATCATCAAAGCGAGGAAGCTCTNCA-------------------- : 801
LpMDHh13  : ------------------------------------------------------------ :   -
LpMDHh14  : ------------------------------------------------------------ :   -
LpMDHh15  : GCAG-------------------------------------------------------- : 764
LpMDHh16  : GCAGCGTGG--------------------------------------------------- : 769
LpMDHh17  : GCANCGTGTG-------------------------------------------------- : 770
LpMDHh18  : GCAGCGTGGTGCTGCAATC----------------------------------------- : 779
LpMDHh19  : ACAGCGTGGTGCTGCAATCATCAAAGCG-------------------------------- : 788
LpMDHh20  : GCAGCGTGGTGCTGCAATCATCAAAGCGAGGAAGC------------------------- : 794
LpMDHh21  : GCAGCGTGGTGCTGCNATCATCAAAGCGAGGAAGCT------------------------ : 797
LpMDHh22  : GCAGCGTGGNGCTGC-ATCATCAAAGCGAGGAAGCTCTNCAGT----------------- : 802
LpMDHh23  : ------------------------------------------------------------ :   -
LpMDHh24  : ------------------------------------------------------------ :   -
LpMDHh25  : ------------------------------------------------------------ :   -
LpMDHh26  : ------------------------------------------------------------ :   -
LpMDHh27  : ------------------------------------------------------------ :   -
LpMDHh28  : GCAGCGTGGTG------------------------------------------------- : 768
LpMDHh29  : GCAGCGTGGTGCTGCAATCATCAAAG---------------------------------- : 783
LpMDHh30  : GCAGCGTGGTGCTGCAATCATCAAAGCGAGGAAGCTCTNCAGTGC--------------- : 803
LpMDHh31  : ------------------------------------------------------------ :   -
LpMDHh32  : ------------------------------------------------------------ :   -
LpMDHh34  : GCAGCGTGGTGCTGCAATCATA-------------------------------------- : 779
LpMDHh35  : ------------------------------------------------------------ :   -
LpMDHh36  : ------------------------------------------------------------ :   -
LpMDHh37  : ------------------------------------------------------------ :   -
LpMDHh38  : ------------------------------------------------------------ :   -
LpMDHh39  : ------------------------------------------------------------ :   -
LpMDHh40  : ------------------------------------------------------------ :   -
LpMDHh41  : ------------------------------------------------------------ :   -
LpMDHh42  : ------------------------------------------------------------ :   -
LpMDHh43  : GCAGCGTC---------------------------------------------------- : 763
LpMDHh44  : GCAGCGTGGTGCTGCAATCATCAAAGCGAGGAAGCT------------------------ : 790
LpMDHh45  : ------------------------------------------------------------ :   -
LpMDHh46  : ------------------------------------------------------------ :   -
LpMDHh47  : ------------------------------------------------------------ :   -
LpMDHh48  : ------------------------------------------------------------ :   -
LpMDHh49  : GCAGCGTGGTGCTGCAATCATCAAAGCGAGGAAGCT------------------------ : 786
LpMDHh50  : GCAGCGTGGTGCTGCAATCATCAAAGCGAGGAAGCTCTCCAGTG---------------- : 772
LpMDHh51  : ------------------------------------------------------------ :   -
LpMDHh52  : GCAGCGTGGTGCTGCAATCATCAAAGCGAGGAAGCTCTCCAGTGCTCTCTCTGCTGCCAGCT : 739
LpMDHh53  : ------------------------------------------------------------ :   -
LpMDHh54  : GCAGCGTGGTGCTGCAATCATCAAAGCGAGGAAGCTNTCCAGTGCTCTNTNGCTGCCAGCT : 490
LpMDHh55  : GCAGCGTGGTGCTGCAATCATCAAAGCGAGGAAGCTCTCCAGTGCTCTCTCTGCTGCCAGCT : 412
LpMDHh56  : GCAGCGTGGTGCTGCAATCATCAAAGCGAGGAAGCTCTCCAGTGCTCTCTCTGCTGCCAGCT : 392
LpMDHh57  : GCAGCGTGGTGCTGCAATCATCAAAGCGAGGAAGCTCTCCAGTGCTCTCTCTGCTGCCAGCT : 388
LpMDHh58  : GCAGCGTGGTGCTGCAATCATCAAAGCGAGGAAGCTCTCCAGTGCTCTCTCTGCTGCCAGCT : 191
LpMDHh59  : GCAGCGTGGTGCTGCAATCATCAAAGCGAGGAAGCTCTCCAGTGCTCTCTCTGCTGCCAGCT : 173
LpMDHh60  : GCAGCGNGGTGCTGCAATCATCAAAGCGAGGAAGCTCTCCAGTGCTCTCTCTGCTGCCAGCT : 137
LpMDHh61  : GCAGCGTGGTGCTGCAATCATCAAAGCGAGGAAGCTCTCCAGTGCTCTCTCTGCTGCCAGCT : 132
LpMDHh62  : ------------------------------------------------------------ :   -
LpMDHh63  : ------------------------------------------------------------ :   -
LpMDHh64  : ------------------------------------------------------------ :   -
```

FIGURE 6 (cont.)

```
              *        880         *        900         *        920         *
LpMDHh1   : ------------------------------------------------------------------- : -
LpMDHh2   : ------------------------------------------------------------------- : -
LpMDHh3   : ------------------------------------------------------------------- : -
LpMDHh4   : ------------------------------------------------------------------- : -
LpMDHh5   : ------------------------------------------------------------------- : -
LpMDHh6   : ------------------------------------------------------------------- : -
LpMDHh7   : ------------------------------------------------------------------- : -
LpMDHh8   : ------------------------------------------------------------------- : -
LpMDHh9   : ------------------------------------------------------------------- : -
LpMDHh10  : ------------------------------------------------------------------- : -
LpMDHh11  : ------------------------------------------------------------------- : -
LpMDHh12  : ------------------------------------------------------------------- : -
LpMDHh13  : ------------------------------------------------------------------- : -
LpMDHh14  : ------------------------------------------------------------------- : -
LpMDHh15  : ------------------------------------------------------------------- : -
LpMDHh16  : ------------------------------------------------------------------- : -
LpMDHh17  : ------------------------------------------------------------------- : -
LpMDHh18  : ------------------------------------------------------------------- : -
LpMDHh19  : ------------------------------------------------------------------- : -
LpMDHh20  : ------------------------------------------------------------------- : -
LpMDHh21  : ------------------------------------------------------------------- : -
LpMDHh22  : ------------------------------------------------------------------- : -
LpMDHh23  : ------------------------------------------------------------------- : -
LpMDHh24  : ------------------------------------------------------------------- : -
LpMDHh25  : ------------------------------------------------------------------- : -
LpMDHh26  : ------------------------------------------------------------------- : -
LpMDHh27  : ------------------------------------------------------------------- : -
LpMDHh28  : ------------------------------------------------------------------- : -
LpMDHh29  : ------------------------------------------------------------------- : -
LpMDHh30  : ------------------------------------------------------------------- : -
LpMDHh31  : ------------------------------------------------------------------- : -
LpMDHh32  : ------------------------------------------------------------------- : -
LpMDHh34  : ------------------------------------------------------------------- : -
LpMDHh35  : ------------------------------------------------------------------- : -
LpMDHh36  : ------------------------------------------------------------------- : -
LpMDHh37  : ------------------------------------------------------------------- : -
LpMDHh38  : ------------------------------------------------------------------- : -
LpMDHh39  : ------------------------------------------------------------------- : -
LpMDHh40  : ------------------------------------------------------------------- : -
LpMDHh41  : ------------------------------------------------------------------- : -
LpMDHh42  : ------------------------------------------------------------------- : -
LpMDHh43  : ------------------------------------------------------------------- : -
LpMDHh44  : ------------------------------------------------------------------- : -
LpMDHh45  : ------------------------------------------------------------------- : -
LpMDHh46  : ------------------------------------------------------------------- : -
LpMDHh47  : ------------------------------------------------------------------- : -
LpMDHh48  : ------------------------------------------------------------------- : -
LpMDHh49  : ------------------------------------------------------------------- : -
LpMDHh50  : ------------------------------------------------------------------- : -
LpMDHh51  : ------------------------------------------------------------------- : -
LpMDHh52  : CTGCTTGTGACCACATCCGTGATT------------------------------------------- : 763
LpMDHh53  : ------------------------------------------------------------------- : -
LpMDHh54  : CTGCTTGTGACCACATCCGGGATTGGGTTCTCGGAACCCCTGAAGGAACATTTGTTTCCATG     : 552
LpMDHh55  : CTGCTTGTGACCACATCCGTGATTGGGTTCTGGAACCCCTGAGGGAACATTTGTTTCCATG      : 474
LpMDHh56  : CTGCTTGTGACCACATCCGTGATTGGGTTCTCGGAACCCCTGAGGGAACATTTGTTTCCATG     : 454
LpMDHh57  : CTGCTTGTGACCACATCCGTGATTGGGTTCTCGGAACCCCTGAGGGAACATTTGTTTCCATG     : 450
LpMDHh58  : CTGCTTGTGACCACATCCGTGATTGGGTTCTCGGAACCCCTGAGGGAACATTTGTTTCCATG     : 253
LpMDHh59  : CTGCTTGTGACCACATCCGTGATTGGGTTCTCGGAACCCCTGAGGGAACATTTGTTTCCATG     : 235
LpMDHh60  : CTGCTTGTGACCACATCCGTGATTGGGTTCTCGGAACCCCTGAGGGAACATTTGTTTCCATG     : 199
LpMDHh61  : CTGCTTGTGACCACATCCGTGATTGGGTTCTCGGAACCCCTGAGGGAACATTTGTTTCCATG     : 194
LpMDHh62  : ------------------------------------------------------------------- : -
LpMDHh63  : ------------------------------------------------------------------- : -
LpMDHh64  : ------------------------------------------------------------------- : -
```

FIGURE 6 (cont.)

```
                        940         *        960         *        980         *
LpMDHh1   : -------------------------------------------------------------- : -
LpMDHh2   : -------------------------------------------------------------- : -
LpMDHh3   : -------------------------------------------------------------- : -
LpMDHh4   : -------------------------------------------------------------- : -
LpMDHh5   : -------------------------------------------------------------- : -
LpMDHh6   : -------------------------------------------------------------- : -
LpMDHh7   : -------------------------------------------------------------- : -
LpMDHh8   : -------------------------------------------------------------- : -
LpMDHh9   : -------------------------------------------------------------- : -
LpMDHh10  : -------------------------------------------------------------- : -
LpMDHh11  : -------------------------------------------------------------- : -
LpMDHh12  : -------------------------------------------------------------- : -
LpMDHh13  : -------------------------------------------------------------- : -
LpMDHh14  : -------------------------------------------------------------- : -
LpMDHh15  : -------------------------------------------------------------- : -
LpMDHh16  : -------------------------------------------------------------- : -
LpMDHh17  : -------------------------------------------------------------- : -
LpMDHh18  : -------------------------------------------------------------- : -
LpMDHh19  : -------------------------------------------------------------- : -
LpMDHh20  : -------------------------------------------------------------- : -
LpMDHh21  : -------------------------------------------------------------- : -
LpMDHh22  : -------------------------------------------------------------- : -
LpMDHh23  : -------------------------------------------------------------- : -
LpMDHh24  : -------------------------------------------------------------- : -
LpMDHh25  : -------------------------------------------------------------- : -
LpMDHh26  : -------------------------------------------------------------- : -
LpMDHh27  : -------------------------------------------------------------- : -
LpMDHh28  : -------------------------------------------------------------- : -
LpMDHh29  : -------------------------------------------------------------- : -
LpMDHh30  : -------------------------------------------------------------- : -
LpMDHh31  : -------------------------------------------------------------- : -
LpMDHh32  : -------------------------------------------------------------- : -
LpMDHh34  : -------------------------------------------------------------- : -
LpMDHh35  : -------------------------------------------------------------- : -
LpMDHh36  : -------------------------------------------------------------- : -
LpMDHh37  : -------------------------------------------------------------- : -
LpMDHh38  : -------------------------------------------------------------- : -
LpMDHh39  : -------------------------------------------------------------- : -
LpMDHh40  : -------------------------------------------------------------- : -
LpMDHh41  : -------------------------------------------------------------- : -
LpMDHh42  : -------------------------------------------------------------- : -
LpMDHh43  : -------------------------------------------------------------- : -
LpMDHh44  : -------------------------------------------------------------- : -
LpMDHh45  : -------------------------------------------------------------- : -
LpMDHh46  : -------------------------------------------------------------- : -
LpMDHh47  : -------------------------------------------------------------- : -
LpMDHh48  : -------------------------------------------------------------- : -
LpMDHh49  : -------------------------------------------------------------- : -
LpMDHh50  : -------------------------------------------------------------- : -
LpMDHh51  : -------------------------------------------------------------- : -
LpMDHh52  : -------------------------------------------------------------- : -
LpMDHh53  : -------------------------------------------------------------- : -
LpMDHh54  : GGTGTGTATTCTGATGGNT-ATACNGNGTGCCTGNTGGGCTTATCTACTCCTTNCCAGNAAC : 613
LpMDHh55  : GGTGTGTATTCTGATGGTTCATACGGTGTGCCTGCTGGGCTTATCTACTCCTTCCCAGTAAC : 536
LpMDHh56  : GNTGTGTATTCTGATGGTTCATACGGTGTGCCTGCTGGGCTTATCTACTCCTTCCCAGTAAC : 516
LpMDHh57  : GGTGTGTATTCTGATGGTTCATACGGTGTGCCTGCTGGGCTTATCTACTCCTTCCCAGTAAC : 512
LpMDHh58  : GGTGTGTATTCTGATGGTTCATACGGTGTGCCTGCTGGGCTTATCTACTCCTTCCCAGTAAC : 315
LpMDHh59  : GGTGTGTATTCTGATGGTTCATACGGTGTGCCTGCTGGGCTTATCTACTCCTTCCCAGTAAC : 297
LpMDHh60  : GGTGTGTATTCTGATGGTTCATACGGTGTGCCTGCTGGGCTTATCTACTCCTTCCCAGTAAC : 261
LpMDHh61  : GGTGTGTATTCTGATGGTTCATACGGTGTGCCTGCTGGGCTTATCTACTCCTTCCCAGTAAC : 256
LpMDHh62  : -------------------------------------------------------------- : -
LpMDHh63  : -------------------------------------------------------------- : -
LpMDHh64  : -------------------------------------------------------------- : -
```

FIGURE 6 (cont.)

```
              1000         *         1020         *         1040         *
LpMDHh1   : ----------------------------------------------------------------- :   -
LpMDHh2   : ----------------------------------------------------------------- :   -
LpMDHh3   : ----------------------------------------------------------------- :   -
LpMDHh4   : ----------------------------------------------------------------- :   -
LpMDHh5   : ----------------------------------------------------------------- :   -
LpMDHh6   : ----------------------------------------------------------------- :   -
LpMDHh7   : ----------------------------------------------------------------- :   -
LpMDHh8   : ----------------------------------------------------------------- :   -
LpMDHh9   : ----------------------------------------------------------------- :   -
LpMDHh10  : ----------------------------------------------------------------- :   -
LpMDHh11  : ----------------------------------------------------------------- :   -
LpMDHh12  : ----------------------------------------------------------------- :   -
LpMDHh13  : ----------------------------------------------------------------- :   -
LpMDHh14  : ----------------------------------------------------------------- :   -
LpMDHh15  : ----------------------------------------------------------------- :   -
LpMDHh16  : ----------------------------------------------------------------- :   -
LpMDHh17  : ----------------------------------------------------------------- :   -
LpMDHh18  : ----------------------------------------------------------------- :   -
LpMDHh19  : ----------------------------------------------------------------- :   -
LpMDHh20  : ----------------------------------------------------------------- :   -
LpMDHh21  : ----------------------------------------------------------------- :   -
LpMDHh22  : ----------------------------------------------------------------- :   -
LpMDHh23  : ----------------------------------------------------------------- :   -
LpMDHh24  : ----------------------------------------------------------------- :   -
LpMDHh25  : ----------------------------------------------------------------- :   -
LpMDHh26  : ----------------------------------------------------------------- :   -
LpMDHh27  : ----------------------------------------------------------------- :   -
LpMDHh28  : ----------------------------------------------------------------- :   -
LpMDHh29  : ----------------------------------------------------------------- :   -
LpMDHh30  : ----------------------------------------------------------------- :   -
LpMDHh31  : ----------------------------------------------------------------- :   -
LpMDHh32  : ----------------------------------------------------------------- :   -
LpMDHh34  : ----------------------------------------------------------------- :   -
LpMDHh35  : ----------------------------------------------------------------- :   -
LpMDHh36  : ----------------------------------------------------------------- :   -
LpMDHh37  : ----------------------------------------------------------------- :   -
LpMDHh38  : ----------------------------------------------------------------- :   -
LpMDHh39  : ----------------------------------------------------------------- :   -
LpMDHh40  : ----------------------------------------------------------------- :   -
LpMDHh41  : ----------------------------------------------------------------- :   -
LpMDHh42  : ----------------------------------------------------------------- :   -
LpMDHh43  : ----------------------------------------------------------------- :   -
LpMDHh44  : ----------------------------------------------------------------- :   -
LpMDHh45  : ----------------------------------------------------------------- :   -
LpMDHh46  : ----------------------------------------------------------------- :   -
LpMDHh47  : ----------------------------------------------------------------- :   -
LpMDHh48  : ----------------------------------------------------------------- :   -
LpMDHh49  : ----------------------------------------------------------------- :   -
LpMDHh50  : ----------------------------------------------------------------- :   -
LpMDHh51  : ----------------------------------------------------------------- :   -
LpMDHh52  : ----------------------------------------------------------------- :   -
LpMDHh53  : ----------------------------------------------------------------- :   -
LpMDHh54  : TTGCTGCGGTGGTGAATGGACAATTGTTCAAGGCTNCCGATCNACNAGTT--------- : 664
LpMDHh55  : TTGCTGCGGTGGTGAATGGACAATTGTTCAAGGGCTCCCGATCGACGAGTTCTCAAGAAAGA : 598
LpMDHh56  : TTGCTGCGGTGGTGAATGGACAATTGTTCAAGGGCTCCCGATCGACGAGTTCTCAAGAAAGA : 578
LpMDHh57  : TTGCTGCGGTGGTGAATGGACAATTGTTCAAGGGCTCCCGATCGACGAGTTCTCAAGAAAGA : 574
LpMDHh58  : TTGCTGCGGTGGTGAATGGACAATTGTTCAAGGGCTCCCGATCGACGAGTTCTCAAGAAAGA : 377
LpMDHh59  : TTGCTGCGGTGGTGAATGGACAATTGTTCAAGGGCTCCCGTCGACGAGTTCTCAAGAAAGA : 359
LpMDHh60  : TTGCTGCGGTGGTGAATGGACAATTGTTCAAGGGCTCCCGATCGACGAGTTCTCAAGAAAGA : 323
LpMDHh61  : TTGCTGCGGTGGTGAATGGACAATTGTTCAAGGGCTCCCGATCGACGAGTTCTCAAGAAAGA : 318
LpMDHh62  : ----------------------------------GTTCCCGAAAACCGAGTTCTC-TTTAG- :  28
LpMDHh63  : ----------------------------------------------------------------- :   -
LpMDHh64  : ----------------------------------------------------------------- :   -
```

FIGURE 6 (cont.)

```
                    1060         *        1080         *        1100         *
LpMDHh1   : ------------------------------------------------------------ :   -
LpMDHh2   : ------------------------------------------------------------ :   -
LpMDHh3   : ------------------------------------------------------------ :   -
LpMDHh4   : ------------------------------------------------------------ :   -
LpMDHh5   : ------------------------------------------------------------ :   -
LpMDHh6   : ------------------------------------------------------------ :   -
LpMDHh7   : ------------------------------------------------------------ :   -
LpMDHh8   : ------------------------------------------------------------ :   -
LpMDHh9   : ------------------------------------------------------------ :   -
LpMDHh10  : ------------------------------------------------------------ :   -
LpMDHh11  : ------------------------------------------------------------ :   -
LpMDHh12  : ------------------------------------------------------------ :   -
LpMDHh13  : ------------------------------------------------------------ :   -
LpMDHh14  : ------------------------------------------------------------ :   -
LpMDHh15  : ------------------------------------------------------------ :   -
LpMDHh16  : ------------------------------------------------------------ :   -
LpMDHh17  : ------------------------------------------------------------ :   -
LpMDHh18  : ------------------------------------------------------------ :   -
LpMDHh19  : ------------------------------------------------------------ :   -
LpMDHh20  : ------------------------------------------------------------ :   -
LpMDHh21  : ------------------------------------------------------------ :   -
LpMDHh22  : ------------------------------------------------------------ :   -
LpMDHh23  : ------------------------------------------------------------ :   -
LpMDHh24  : ------------------------------------------------------------ :   -
LpMDHh25  : ------------------------------------------------------------ :   -
LpMDHh26  : ------------------------------------------------------------ :   -
LpMDHh27  : ------------------------------------------------------------ :   -
LpMDHh28  : ------------------------------------------------------------ :   -
LpMDHh29  : ------------------------------------------------------------ :   -
LpMDHh30  : ------------------------------------------------------------ :   -
LpMDHh31  : ------------------------------------------------------------ :   -
LpMDHh32  : ------------------------------------------------------------ :   -
LpMDHh34  : ------------------------------------------------------------ :   -
LpMDHh35  : ------------------------------------------------------------ :   -
LpMDHh36  : ------------------------------------------------------------ :   -
LpMDHh37  : ------------------------------------------------------------ :   -
LpMDHh38  : ------------------------------------------------------------ :   -
LpMDHh39  : ------------------------------------------------------------ :   -
LpMDHh40  : ------------------------------------------------------------ :   -
LpMDHh41  : ------------------------------------------------------------ :   -
LpMDHh42  : ------------------------------------------------------------ :   -
LpMDHh43  : ------------------------------------------------------------ :   -
LpMDHh44  : ------------------------------------------------------------ :   -
LpMDHh45  : ------------------------------------------------------------ :   -
LpMDHh46  : ------------------------------------------------------------ :   -
LpMDHh47  : ------------------------------------------------------------ :   -
LpMDHh48  : ------------------------------------------------------------ :   -
LpMDHh49  : ------------------------------------------------------------ :   -
LpMDHh50  : ------------------------------------------------------------ :   -
LpMDHh51  : ------------------------------------------------------------ :   -
LpMDHh52  : ------------------------------------------------------------ :   -
LpMDHh53  : ------------------------------------------------------------ :   -
LpMDHh54  : ------------------------------------------------------------ :   -
LpMDHh55  : AGATGGATGCCACAGCCCAGGAGCTCTCGGAGGAGAAGGCTCTCGCCTACTCGTGCCTCGAG : 660
LpMDHh56  : AGATGGATGCCACAGCCCAGGAGCTCTCGGAGGAGAAGGCTCTCGCCTACTCGTGCCTCGAG : 640
LpMDHh57  : AGATGGATGCCACAGCCCAGGAGCTCTCGGAGGAGAAGGCTCTCGCCTACTCGTGCCTCGAG : 636
LpMDHh58  : AGATGGATGCCACAGCCCAGGAGCTCTCGGAGGAGAAGGCTCTCGCCTACTCGTGCCTCGAG : 439
LpMDHh59  : AGATGGATGCCACAGCCCAGGAGCTCTCGGAGGAGAAGGCTCTCGCCTACTCGTGCCTCGAG : 421
LpMDHh60  : AGATGGATGCCACAGCCCAGGAGCTCTCGGAGGAGAAGGCTCTCGCCTACTCGTGCCTCGAG : 385
LpMDHh61  : AGATGGATGCCACAGCCCAGGAGCTCTCGGAGGAGAAGGCTCTCGCCTACTCGTGCCTCGAG : 380
LpMDHh62  : AGA-GGAGCCACAGCCCAGGAGCTCTCGGAGGAGAAGGTNTCGCCTACTCGGGCCTCGAG   :  89
LpMDHh63  : ---------------------------CTCGGAGGAGAAGGCTCTCGCCTACTCGTGCCTCGAG :  38
LpMDHh64  : ------------------------------------------------------------ :   -
```

FIGURE 6 (cont.)

|             | 1120 | * | 1140 | * | 1160 | * | 11 |   |     |
|-------------|------|---|------|---|------|---|----|---|-----|
| LpMDHh1  | ------------------------------------------------------------ | : | -   |
| LpMDHh2  | ------------------------------------------------------------ | : | -   |
| LpMDHh3  | ------------------------------------------------------------ | : | -   |
| LpMDHh4  | ------------------------------------------------------------ | : | -   |
| LpMDHh5  | ------------------------------------------------------------ | : | -   |
| LpMDHh6  | ------------------------------------------------------------ | : | -   |
| LpMDHh7  | ------------------------------------------------------------ | : | -   |
| LpMDHh8  | ------------------------------------------------------------ | : | -   |
| LpMDHh9  | ------------------------------------------------------------ | : | -   |
| LpMDHh10 | ------------------------------------------------------------ | : | -   |
| LpMDHh11 | ------------------------------------------------------------ | : | -   |
| LpMDHh12 | ------------------------------------------------------------ | : | -   |
| LpMDHh13 | ------------------------------------------------------------ | : | -   |
| LpMDHh14 | ------------------------------------------------------------ | : | -   |
| LpMDHh15 | ------------------------------------------------------------ | : | -   |
| LpMDHh16 | ------------------------------------------------------------ | : | -   |
| LpMDHh17 | ------------------------------------------------------------ | : | -   |
| LpMDHh18 | ------------------------------------------------------------ | : | -   |
| LpMDHh19 | ------------------------------------------------------------ | : | -   |
| LpMDHh20 | ------------------------------------------------------------ | : | -   |
| LpMDHh21 | ------------------------------------------------------------ | : | -   |
| LpMDHh22 | ------------------------------------------------------------ | : | -   |
| LpMDHh23 | ------------------------------------------------------------ | : | -   |
| LpMDHh24 | ------------------------------------------------------------ | : | -   |
| LpMDHh25 | ------------------------------------------------------------ | : | -   |
| LpMDHh26 | ------------------------------------------------------------ | : | -   |
| LpMDHh27 | ------------------------------------------------------------ | : | -   |
| LpMDHh28 | ------------------------------------------------------------ | : | -   |
| LpMDHh29 | ------------------------------------------------------------ | : | -   |
| LpMDHh30 | ------------------------------------------------------------ | : | -   |
| LpMDHh31 | ------------------------------------------------------------ | : | -   |
| LpMDHh32 | ------------------------------------------------------------ | : | -   |
| LpMDHh34 | ------------------------------------------------------------ | : | -   |
| LpMDHh35 | ------------------------------------------------------------ | : | -   |
| LpMDHh36 | ------------------------------------------------------------ | : | -   |
| LpMDHh37 | ------------------------------------------------------------ | : | -   |
| LpMDHh38 | ------------------------------------------------------------ | : | -   |
| LpMDHh39 | ------------------------------------------------------------ | : | -   |
| LpMDHh40 | ------------------------------------------------------------ | : | -   |
| LpMDHh41 | ------------------------------------------------------------ | : | -   |
| LpMDHh42 | ------------------------------------------------------------ | : | -   |
| LpMDHh43 | ------------------------------------------------------------ | : | -   |
| LpMDHh44 | ------------------------------------------------------------ | : | -   |
| LpMDHh45 | ------------------------------------------------------------ | : | -   |
| LpMDHh46 | ------------------------------------------------------------ | : | -   |
| LpMDHh47 | ------------------------------------------------------------ | : | -   |
| LpMDHh48 | ------------------------------------------------------------ | : | -   |
| LpMDHh49 | ------------------------------------------------------------ | : | -   |
| LpMDHh50 | ------------------------------------------------------------ | : | -   |
| LpMDHh51 | ------------------------------------------------------------ | : | -   |
| LpMDHh52 | ------------------------------------------------------------ | : | -   |
| LpMDHh53 | ------------------------------------------------------------ | : | -   |
| LpMDHh54 | ------------------------------------------------------------ | : | -   |
| LpMDHh55 | TAACTGCATACCAGGGAGCAGCTGCCGCTCTGATGTTTTGAATAAAAGGAACATTTTGGCTN | : | 722 |
| LpMDHh56 | TAACTGCATACCAGGGAGCAGCTGCCGCTCTGATGTTTTGAATAAAA-GNACATTTTGNCTN | : | 701 |
| LpMDHh57 | TAACTGCATACCAGGGAGCAGCTGCCGCTCT----------------------------- | : | 667 |
| LpMDHh58 | TAACTGCATACCAGGGAGCAGCTGCCGCTCTGATGTTTTGAATAAAAGGAACATTTTGGCTC | : | 501 |
| LpMDHh59 | TAACTGCATACCAGGGAGCAGCTGCCGCTCTGATGTTTTGAATAAAAGGAACATTTTGGCTC | : | 483 |
| LpMDHh60 | TAACTGCATACCAGGGAGCAGCTGCCGCTCTGATGTTTTGAATAAAAGGAACATTTTGGCTC | : | 447 |
| LpMDHh61 | TAACTGCATACCAGGGAGCAGCTGCCGCTCTGATGTTTTGAATAAAAGGAACATTTTGGCTC | : | 442 |
| LpMDHh62 | TAACTGCATACCAGGGAGCAGCTGCCGCTCTGATGTTTTGAATAAAAGGAACATTTTGGCTC | : | 151 |
| LpMDHh63 | TAACTGCATACCAGGGAGCAGCTGCCGCTCTGATGTTTTGAATAAAAGGAACATTTTGGCTC | : | 100 |
| LpMDHh64 | ------------------------------------------------------------ | : | -   |

FIGURE 6 (cont.)

```
                 80         *        1200         *        1220         *       1240
LpMDHh1   : ------------------------------------------------------------ : -
LpMDHh2   : ------------------------------------------------------------ : -
LpMDHh3   : ------------------------------------------------------------ : -
LpMDHh4   : ------------------------------------------------------------ : -
LpMDHh5   : ------------------------------------------------------------ : -
LpMDHh6   : ------------------------------------------------------------ : -
LpMDHh7   : ------------------------------------------------------------ : -
LpMDHh8   : ------------------------------------------------------------ : -
LpMDHh9   : ------------------------------------------------------------ : -
LpMDHh10  : ------------------------------------------------------------ : -
LpMDHh11  : ------------------------------------------------------------ : -
LpMDHh12  : ------------------------------------------------------------ : -
LpMDHh13  : ------------------------------------------------------------ : -
LpMDHh14  : ------------------------------------------------------------ : -
LpMDHh15  : ------------------------------------------------------------ : -
LpMDHh16  : ------------------------------------------------------------ : -
LpMDHh17  : ------------------------------------------------------------ : -
LpMDHh18  : ------------------------------------------------------------ : -
LpMDHh19  : ------------------------------------------------------------ : -
LpMDHh20  : ------------------------------------------------------------ : -
LpMDHh21  : ------------------------------------------------------------ : -
LpMDHh22  : ------------------------------------------------------------ : -
LpMDHh23  : ------------------------------------------------------------ : -
LpMDHh24  : ------------------------------------------------------------ : -
LpMDHh25  : ------------------------------------------------------------ : -
LpMDHh26  : ------------------------------------------------------------ : -
LpMDHh27  : ------------------------------------------------------------ : -
LpMDHh28  : ------------------------------------------------------------ : -
LpMDHh29  : ------------------------------------------------------------ : -
LpMDHh30  : ------------------------------------------------------------ : -
LpMDHh31  : ------------------------------------------------------------ : -
LpMDHh32  : ------------------------------------------------------------ : -
LpMDHh34  : ------------------------------------------------------------ : -
LpMDHh35  : ------------------------------------------------------------ : -
LpMDHh36  : ------------------------------------------------------------ : -
LpMDHh37  : ------------------------------------------------------------ : -
LpMDHh38  : ------------------------------------------------------------ : -
LpMDHh39  : ------------------------------------------------------------ : -
LpMDHh40  : ------------------------------------------------------------ : -
LpMDHh41  : ------------------------------------------------------------ : -
LpMDHh42  : ------------------------------------------------------------ : -
LpMDHh43  : ------------------------------------------------------------ : -
LpMDHh44  : ------------------------------------------------------------ : -
LpMDHh45  : ------------------------------------------------------------ : -
LpMDHh46  : ------------------------------------------------------------ : -
LpMDHh47  : ------------------------------------------------------------ : -
LpMDHh48  : ------------------------------------------------------------ : -
LpMDHh49  : ------------------------------------------------------------ : -
LpMDHh50  : ------------------------------------------------------------ : -
LpMDHh51  : ------------------------------------------------------------ : -
LpMDHh52  : ------------------------------------------------------------ : -
LpMDHh53  : ------------------------------------------------------------ : -
LpMDHh54  : ------------------------------------------------------------ : -
LpMDHh55  : CATGAAACTCAT------------------------------------------------ : 734
LpMDHh56  : CATG-------------------------------------------------------- : 705
LpMDHh57  : ------------------------------------------------------------ : -
LpMDHh58  : CATGAAACTCATCTCCACTCAGAACAGTTGCACATCGCGGTGCCTTTAGCTGGTTTTTCCAG : 563
LpMDHh59  : CATGAAACTCATCTCCACTCAGAACAGTTGCACATCGCGGTGCCTTTAGCTGGTTTTTCCAG : 545
LpMDHh60  : CATGAAACTCATCTCCACTCAGAACAGTTGCACATCGCGGTGCCTTAAGCTGGTTTTTCCAG : 509
LpMDHh61  : CATGAAACTCATCTCCACTCAGAACAGTTGCACATCGCGGTGCCTTTAGCTGGTTTTTCCAG : 504
LpMDHh62  : CATGAAACTCATCTCCACTCAGAACAGTTGCACATCGCGGTGCCTTTAGCTGGTTTTTCCAG : 213
LpMDHh63  : CATGAAACTCATCTCCACTCAGAACAGTTGCACATCGCGGTGCCTTTAGCTGGTTTTTCCAG : 162
LpMDHh64  : ------------------------------------------------------------ : -
```

FIGURE 6 (cont.)

|         | * | 1260 | * | 1280 | * | 1300 | | |
|---------|---|------|---|------|---|------|---|---|
| LpMDHh1 | ---------------------------------------------------------- | : | - |
| LpMDHh2 | ---------------------------------------------------------- | : | - |
| LpMDHh3 | ---------------------------------------------------------- | : | - |
| LpMDHh4 | ---------------------------------------------------------- | : | - |
| LpMDHh5 | ---------------------------------------------------------- | : | - |
| LpMDHh6 | ---------------------------------------------------------- | : | - |
| LpMDHh7 | ---------------------------------------------------------- | : | - |
| LpMDHh8 | ---------------------------------------------------------- | : | - |
| LpMDHh9 | ---------------------------------------------------------- | : | - |
| LpMDHh10 | ---------------------------------------------------------- | : | - |
| LpMDHh11 | ---------------------------------------------------------- | : | - |
| LpMDHh12 | ---------------------------------------------------------- | : | - |
| LpMDHh13 | ---------------------------------------------------------- | : | - |
| LpMDHh14 | ---------------------------------------------------------- | : | - |
| LpMDHh15 | ---------------------------------------------------------- | : | - |
| LpMDHh16 | ---------------------------------------------------------- | : | - |
| LpMDHh17 | ---------------------------------------------------------- | : | - |
| LpMDHh18 | ---------------------------------------------------------- | : | - |
| LpMDHh19 | ---------------------------------------------------------- | : | - |
| LpMDHh20 | ---------------------------------------------------------- | : | - |
| LpMDHh21 | ---------------------------------------------------------- | : | - |
| LpMDHh22 | ---------------------------------------------------------- | : | - |
| LpMDHh23 | ---------------------------------------------------------- | : | - |
| LpMDHh24 | ---------------------------------------------------------- | : | - |
| LpMDHh25 | ---------------------------------------------------------- | : | - |
| LpMDHh26 | ---------------------------------------------------------- | : | - |
| LpMDHh27 | ---------------------------------------------------------- | : | - |
| LpMDHh28 | ---------------------------------------------------------- | : | - |
| LpMDHh29 | ---------------------------------------------------------- | : | - |
| LpMDHh30 | ---------------------------------------------------------- | : | - |
| LpMDHh31 | ---------------------------------------------------------- | : | - |
| LpMDHh32 | ---------------------------------------------------------- | : | - |
| LpMDHh34 | ---------------------------------------------------------- | : | - |
| LpMDHh35 | ---------------------------------------------------------- | : | - |
| LpMDHh36 | ---------------------------------------------------------- | : | - |
| LpMDHh37 | ---------------------------------------------------------- | : | - |
| LpMDHh38 | ---------------------------------------------------------- | : | - |
| LpMDHh39 | ---------------------------------------------------------- | : | - |
| LpMDHh40 | ---------------------------------------------------------- | : | - |
| LpMDHh41 | ---------------------------------------------------------- | : | - |
| LpMDHh42 | ---------------------------------------------------------- | : | - |
| LpMDHh43 | ---------------------------------------------------------- | : | - |
| LpMDHh44 | ---------------------------------------------------------- | : | - |
| LpMDHh45 | ---------------------------------------------------------- | : | - |
| LpMDHh46 | ---------------------------------------------------------- | : | - |
| LpMDHh47 | ---------------------------------------------------------- | : | - |
| LpMDHh48 | ---------------------------------------------------------- | : | - |
| LpMDHh49 | ---------------------------------------------------------- | : | - |
| LpMDHh50 | ---------------------------------------------------------- | : | - |
| LpMDHh51 | ---------------------------------------------------------- | : | - |
| LpMDHh52 | ---------------------------------------------------------- | : | - |
| LpMDHh53 | ---------------------------------------------------------- | : | - |
| LpMDHh54 | ---------------------------------------------------------- | : | - |
| LpMDHh55 | ---------------------------------------------------------- | : | - |
| LpMDHh56 | ---------------------------------------------------------- | : | - |
| LpMDHh57 | ---------------------------------------------------------- | : | - |
| LpMDHh58 | TGTGTATGAATGAGGCTTTTGTAGCTCTATTTTCGCCTGATGATTTACAGGACAGGATATTG | : | 625 |
| LpMDHh59 | TGTGTATGAATGAGGCTTTTGTAGCTCTATTTTCGCCTGATGATTTACAGGACAGGATATTG | : | 607 |
| LpMDHh60 | TGTGTATGAATGAGGCTTTTGTAGCTCTATTTTCGCCTGATGATTTACAGGACAGGATATTG | : | 571 |
| LpMDHh61 | TGTGTATGAATGAGGCTTTTGTAGCCCTATTTTCGCCTGATGATTTACAGGACAGGATATTG | : | 566 |
| LpMDHh62 | TGTGTATGANTGAGGCTTTTGTAGCCCTATTTTCGCCTGATGATTTACAGGACAGGATATTG | : | 275 |
| LpMDHh63 | TGTGTATGAATGAGGCTTTTGTAGCTCTATTTTCGCCTGATGATTTACAGGACAGGATATTG | : | 224 |
| LpMDHh64 | ------GNANGNAGCTTTTGTAGCTCTATTTTCGCCTGNAGATTTACAGGACAGGATATTG | : | 55 |

FIGURE 6 (cont.)

```
                    *        1320        *        1340        *        1360
LpMDHh1   : ------------------------------------------------------------- : -
LpMDHh2   : ------------------------------------------------------------- : -
LpMDHh3   : ------------------------------------------------------------- : -
LpMDHh4   : ------------------------------------------------------------- : -
LpMDHh5   : ------------------------------------------------------------- : -
LpMDHh6   : ------------------------------------------------------------- : -
LpMDHh7   : ------------------------------------------------------------- : -
LpMDHh8   : ------------------------------------------------------------- : -
LpMDHh9   : ------------------------------------------------------------- : -
LpMDHh10  : ------------------------------------------------------------- : -
LpMDHh11  : ------------------------------------------------------------- : -
LpMDHh12  : ------------------------------------------------------------- : -
LpMDHh13  : ------------------------------------------------------------- : -
LpMDHh14  : ------------------------------------------------------------- : -
LpMDHh15  : ------------------------------------------------------------- : -
LpMDHh16  : ------------------------------------------------------------- : -
LpMDHh17  : ------------------------------------------------------------- : -
LpMDHh18  : ------------------------------------------------------------- : -
LpMDHh19  : ------------------------------------------------------------- : -
LpMDHh20  : ------------------------------------------------------------- : -
LpMDHh21  : ------------------------------------------------------------- : -
LpMDHh22  : ------------------------------------------------------------- : -
LpMDHh23  : ------------------------------------------------------------- : -
LpMDHh24  : ------------------------------------------------------------- : -
LpMDHh25  : ------------------------------------------------------------- : -
LpMDHh26  : ------------------------------------------------------------- : -
LpMDHh27  : ------------------------------------------------------------- : -
LpMDHh28  : ------------------------------------------------------------- : -
LpMDHh29  : ------------------------------------------------------------- : -
LpMDHh30  : ------------------------------------------------------------- : -
LpMDHh31  : ------------------------------------------------------------- : -
LpMDHh32  : ------------------------------------------------------------- : -
LpMDHh34  : ------------------------------------------------------------- : -
LpMDHh35  : ------------------------------------------------------------- : -
LpMDHh36  : ------------------------------------------------------------- : -
LpMDHh37  : ------------------------------------------------------------- : -
LpMDHh38  : ------------------------------------------------------------- : -
LpMDHh39  : ------------------------------------------------------------- : -
LpMDHh40  : ------------------------------------------------------------- : -
LpMDHh41  : ------------------------------------------------------------- : -
LpMDHh42  : ------------------------------------------------------------- : -
LpMDHh43  : ------------------------------------------------------------- : -
LpMDHh44  : ------------------------------------------------------------- : -
LpMDHh45  : ------------------------------------------------------------- : -
LpMDHh46  : ------------------------------------------------------------- : -
LpMDHh47  : ------------------------------------------------------------- : -
LpMDHh48  : ------------------------------------------------------------- : -
LpMDHh49  : ------------------------------------------------------------- : -
LpMDHh50  : ------------------------------------------------------------- : -
LpMDHh51  : ------------------------------------------------------------- : -
LpMDHh52  : ------------------------------------------------------------- : -
LpMDHh53  : ------------------------------------------------------------- : -
LpMDHh54  : ------------------------------------------------------------- : -
LpMDHh55  : ------------------------------------------------------------- : -
LpMDHh56  : ------------------------------------------------------------- : -
LpMDHh57  : ------------------------------------------------------------- : -
LpMDHh58  : GCAGGAAGATTGGAACAATTTGACGTCTGATTAAAACCAACCTCTTATTATTCCGTGTGTA : 687
LpMDHh59  : GCAGGAAGATTGGAACAATTTGACGTCTGATTAAAACCA--------------------- : 646
LpMDHh60  : GCAGGAAGATTGGAACAATTTGACGTCTGATTAAAACCAACCTCTTATTATTCCTGTGTA : 633
LpMDHh61  : GCAGGAAGATTGGAACAATTTGACGTCTGATTAAAACCAACCTCTTATTA---------- : 616
LpMDHh62  : GCAGGAAGATTGGAACAATTTGACGTCTGATTAAAACCAACCTCTTATTATTCCTGTGTA : 337
LpMDHh63  : GCAGGAAGATTGGAACAATTTGACGTCTGAAAAAAAAAA--------------------- : 265
LpMDHh64  : GCAGGAAGATTGGAACAATTTGACGTCTGATTAAAACCAACCTCTTA-TATTCCTGTGTA : 116
```

```
                       *        1380         *        1400         *        1420
LpMDHh1   : ------------------------------------------------------------ :   -
LpMDHh2   : ------------------------------------------------------------ :   -
LpMDHh3   : ------------------------------------------------------------ :   -
LpMDHh4   : ------------------------------------------------------------ :   -
LpMDHh5   : ------------------------------------------------------------ :   -
LpMDHh6   : ------------------------------------------------------------ :   -
LpMDHh7   : ------------------------------------------------------------ :   -
LpMDHh8   : ------------------------------------------------------------ :   -
LpMDHh9   : ------------------------------------------------------------ :   -
LpMDHh10  : ------------------------------------------------------------ :   -
LpMDHh11  : ------------------------------------------------------------ :   -
LpMDHh12  : ------------------------------------------------------------ :   -
LpMDHh13  : ------------------------------------------------------------ :   -
LpMDHh14  : ------------------------------------------------------------ :   -
LpMDHh15  : ------------------------------------------------------------ :   -
LpMDHh16  : ------------------------------------------------------------ :   -
LpMDHh17  : ------------------------------------------------------------ :   -
LpMDHh18  : ------------------------------------------------------------ :   -
LpMDHh19  : ------------------------------------------------------------ :   -
LpMDHh20  : ------------------------------------------------------------ :   -
LpMDHh21  : ------------------------------------------------------------ :   -
LpMDHh22  : ------------------------------------------------------------ :   -
LpMDHh23  : ------------------------------------------------------------ :   -
LpMDHh24  : ------------------------------------------------------------ :   -
LpMDHh25  : ------------------------------------------------------------ :   -
LpMDHh26  : ------------------------------------------------------------ :   -
LpMDHh27  : ------------------------------------------------------------ :   -
LpMDHh28  : ------------------------------------------------------------ :   -
LpMDHh29  : ------------------------------------------------------------ :   -
LpMDHh30  : ------------------------------------------------------------ :   -
LpMDHh31  : ------------------------------------------------------------ :   -
LpMDHh32  : ------------------------------------------------------------ :   -
LpMDHh34  : ------------------------------------------------------------ :   -
LpMDHh35  : ------------------------------------------------------------ :   -
LpMDHh36  : ------------------------------------------------------------ :   -
LpMDHh37  : ------------------------------------------------------------ :   -
LpMDHh38  : ------------------------------------------------------------ :   -
LpMDHh39  : ------------------------------------------------------------ :   -
LpMDHh40  : ------------------------------------------------------------ :   -
LpMDHh41  : ------------------------------------------------------------ :   -
LpMDHh42  : ------------------------------------------------------------ :   -
LpMDHh43  : ------------------------------------------------------------ :   -
LpMDHh44  : ------------------------------------------------------------ :   -
LpMDHh45  : ------------------------------------------------------------ :   -
LpMDHh46  : ------------------------------------------------------------ :   -
LpMDHh47  : ------------------------------------------------------------ :   -
LpMDHh48  : ------------------------------------------------------------ :   -
LpMDHh49  : ------------------------------------------------------------ :   -
LpMDHh50  : ------------------------------------------------------------ :   -
LpMDHh51  : ------------------------------------------------------------ :   -
LpMDHh52  : ------------------------------------------------------------ :   -
LpMDHh53  : ------------------------------------------------------------ :   -
LpMDHh54  : ------------------------------------------------------------ :   -
LpMDHh55  : ------------------------------------------------------------ :   -
LpMDHh56  : ------------------------------------------------------------ :   -
LpMDHh57  : ------------------------------------------------------------ :   -
LpMDHh58  : TGAATGAGGCTTTTGTAGCTCTATTTTCGCCTGATGATTTACAGGCCATGATATTGGCAGG- : 748
LpMDHh59  : ------------------------------------------------------------ :   -
LpMDHh60  : TGAATGAGGCTTTTGTAGCTCTATTTTCGCCTGATGATTTACAGGCCATGATATTGGCAGGA : 695
LpMDHh61  : ------------------------------------------------------------ :   -
LpMDHh62  : TGAATGAGGCTTTTGTAGCTCTATTTTCGCCTGATGATTTACAGGCATCATATTGGCAGGA  : 399
LpMDHh63  : ------------------------------------------------------------ :   -
LpMDHh64  : TGAATGAGGCTTTTGTAGCTCTATTTTCGCCTGATGATTTACAGGCCAGATATTGGCAGGA  : 178
```

FIGURE 6 (cont.)

```
                *      1440       *      1460       *      1480
LpMDHh1   : ---------------------------------------------------- :   -
LpMDHh2   : ---------------------------------------------------- :   -
LpMDHh3   : ---------------------------------------------------- :   -
LpMDHh4   : ---------------------------------------------------- :   -
LpMDHh5   : ---------------------------------------------------- :   -
LpMDHh6   : ---------------------------------------------------- :   -
LpMDHh7   : ---------------------------------------------------- :   -
LpMDHh8   : ---------------------------------------------------- :   -
LpMDHh9   : ---------------------------------------------------- :   -
LpMDHh10  : ---------------------------------------------------- :   -
LpMDHh11  : ---------------------------------------------------- :   -
LpMDHh12  : ---------------------------------------------------- :   -
LpMDHh13  : ---------------------------------------------------- :   -
LpMDHh14  : ---------------------------------------------------- :   -
LpMDHh15  : ---------------------------------------------------- :   -
LpMDHh16  : ---------------------------------------------------- :   -
LpMDHh17  : ---------------------------------------------------- :   -
LpMDHh18  : ---------------------------------------------------- :   -
LpMDHh19  : ---------------------------------------------------- :   -
LpMDHh20  : ---------------------------------------------------- :   -
LpMDHh21  : ---------------------------------------------------- :   -
LpMDHh22  : ---------------------------------------------------- :   -
LpMDHh23  : ---------------------------------------------------- :   -
LpMDHh24  : ---------------------------------------------------- :   -
LpMDHh25  : ---------------------------------------------------- :   -
LpMDHh26  : ---------------------------------------------------- :   -
LpMDHh27  : ---------------------------------------------------- :   -
LpMDHh28  : ---------------------------------------------------- :   -
LpMDHh29  : ---------------------------------------------------- :   -
LpMDHh30  : ---------------------------------------------------- :   -
LpMDHh31  : ---------------------------------------------------- :   -
LpMDHh32  : ---------------------------------------------------- :   -
LpMDHh34  : ---------------------------------------------------- :   -
LpMDHh35  : ---------------------------------------------------- :   -
LpMDHh36  : ---------------------------------------------------- :   -
LpMDHh37  : ---------------------------------------------------- :   -
LpMDHh38  : ---------------------------------------------------- :   -
LpMDHh39  : ---------------------------------------------------- :   -
LpMDHh40  : ---------------------------------------------------- :   -
LpMDHh41  : ---------------------------------------------------- :   -
LpMDHh42  : ---------------------------------------------------- :   -
LpMDHh43  : ---------------------------------------------------- :   -
LpMDHh44  : ---------------------------------------------------- :   -
LpMDHh45  : ---------------------------------------------------- :   -
LpMDHh46  : ---------------------------------------------------- :   -
LpMDHh47  : ---------------------------------------------------- :   -
LpMDHh48  : ---------------------------------------------------- :   -
LpMDHh49  : ---------------------------------------------------- :   -
LpMDHh50  : ---------------------------------------------------- :   -
LpMDHh51  : ---------------------------------------------------- :   -
LpMDHh52  : ---------------------------------------------------- :   -
LpMDHh53  : ---------------------------------------------------- :   -
LpMDHh54  : ---------------------------------------------------- :   -
LpMDHh55  : ---------------------------------------------------- :   -
LpMDHh56  : ---------------------------------------------------- :   -
LpMDHh57  : ---------------------------------------------------- :   -
LpMDHh58  : ---------------------------------------------------- :   -
LpMDHh59  : ---------------------------------------------------- :   -
LpMDHh60  : GGATTGGAACAATTTGACGCCTGATTAAAACCAACCTCTTATTACTAAAAAAAA--- : 750
LpMDHh61  : ---------------------------------------------------- :   -
LpMDHh62  : GGATTGGAACAANNNANANN-------------------------------- : 418
LpMDHh63  : ---------------------------------------------------- :   -
LpMDHh64  : GGATTGGAACAATTTGACGCCTGATTAAAACCAACCTCTTATTA T AAAAAAAAAA : 236
```

```
                          *         140         *         160         *         180
LpMDHk1  : AAGTTGGAGATGGCATCAGCTGTTACCATCAGCTCAGTCAGCGCGCAGGCCGCTTTGGTC : 178
LpMDHk2  : AAGTTGGAGATGGCATCAGCTGTTACCATCAGCTCAGTCAGCGCGCAGGCCGCTTTGGTC : 145
LpMDHk3  : AAGTTGGAGATGGCATCAGCTGTTACCATCAGTTCGGTCAGCGCGCAGTCCGCTCTGGTT : 146
LpMDHk4  : AAGTTGGAGATGGCATCAGCTGTTACCATCAGCTCAGTCAGCGCGCAGGCCGCTTTGGTC : 144
LpMDHk5  : AAGTTGGAGATGGCATCAGCTGTTACCATCAGCTCAGTCAGCGCGCAGGCCGCTTTGGTC : 145
LpMDHk6  : AAGTTGGAGATGGCATCAGCTGTTACCATCAGTTCGGTCAGCGCGCAGTCCGCTCTGGTT : 144
LpMDHk7  : AAGTTGGAGATGGCATCAGCTGTTACCATCAGCTCAGTCAGCGCGCAGGCCGCTTTGGTC : 142
LpMDHk8  : AAGTTGGAGATGGCATCAGCTGTTACCATCAGCTCAGTCAGCGCGCAGGCCGCTTTGGTC : 143
LpMDHk9  : AAGTTGGAGATGGCATCAGCTGTTACCATCAGCTCAGTCAGCGCGCAGGCCGCTTTGGTC : 143
LpMDHk10 : AAGTTGGAGATGGCATCAGCTGTTACCATCAGCTCAGTCAGCGCGCAGGCCGCTTTGGTC : 142
LpMDHk11 : AAGTTGGNAATGGCATCAGCTGTTACCATCAGTTCGGTCAGCGCGCAGTCCGCTCTGGTT : 141
LpMDHk12 : AAGTTGGGGATGGCATCAGCTGTTACCATCAGCTCAGTCAGCGCGCAGGCCGCTTTGGTC : 142
LpMDHk13 : AAGTTGGAGATGGCATCAGCTGTTACCATCAGCTCAGTCAGCGCGCAGGCCGCTTTGGTC : 141
LpMDHk14 : AAGTTGGAGATGGCATCAGCTGTTACCATCAGTTCAGTCAGCGCGCAGGCCGCTTTGGTC : 140
LpMDHk15 : AAGTTGGAGATGGCATCAGCTGTTACCATCAGCTCAGTCAGCGCGCAGGCCGCTTTGGTC : 139
LpMDHk16 : AAGTTGGAGATGGCATCAGCTGTTACCATCAGCTCAGTCAGCGCGCAGGCCGCTTTGGTC : 139
LpMDHk17 : AAGTTGGCNATGGCATCAGCTGTTACCATCAGCTCAGTCAGCGCGCAGGCCGCTTTGGTC : 138
LpMDHk18 : AAGTTGGAGATGGCATCAGCTGTTACCATCAGCTCAGTCAGCGCGCAGGCCGCTTGGTC : 140
LpMDHk19 : AAGTTGGAGATGGCATCAGCTGTTACCATCAGCTCAGTCAGCGCGCAGGCCGCTTTGGTC : 140
LpMDHk20 : AAGTTGGAGATGGCATCAGCTGTTACCATCAGCTCAGTCAGCGCGCAGGCCGCTTTGGTC : 140
LpMDHk21 : AAGTTGGAGATGGCATCAGCTGTTACCATCAGCTCAGTCAGCGCGCAGGCCGCTTTGGTC : 140
LpMDHk22 : AAGTTGGAGATGGCATCAGCTGTTACCATCAGCTCAGTCAGCGCGCAGGCCGCTTGGTC : 140
LpMDHk23 : AAGTTGGAGATGGCATCAGCTGTTACCATCAGCTCAGTCAGCGCGCAGGCCGCTTTGGTC : 137
LpMDHk24 : AAGTTGGAGATGGCATCAGCTGTTACCATCAGCTCAGTCAGCGCGCAGGCCGCTTTGGTC : 137
LpMDHk25 : AAGTTGGAGATGGCATCAGCTGTTACCATCAGCTCAGTCAGCGCGCAGGCCGCTTTGGTC : 137
LpMDHk26 : AAGTTGGAGATGGCATCAGCTGTTACCATCAGCTCAGTCAGCGCGCAGGCCGCTTTCATC : 139
LpMDHk27 : AAGTTGGAGATGGCATCAGCTGTTACCATCAGCTCAGTCAGCGCGCAGGCCGCTTTGGTC : 138
LpMDHk28 : AAGTTGGAGATGGCATCAGCTGTTACCATCAGCTCAGTCAGCGCGCAGGCCGCTTTGGTC : 139
LpMDHk29 : AAGTTGGGGATGGCATCAGCTGTTACCATCAGCTCAGTCAGCGCGCAGGCCGCTTTGGTC : 134
LpMDHk30 : AAGTTGGAGATGGCATCAGCTGTTACCATCAGCTCAGTCAGCGCGCAGGCCGCTTTGGTC : 138
LpMDHk31 : AAGTTGGAGATGGCATCAGCTGTTACCATCAGCTCAGTCAGCGCGCAGGCCGCTTTGGTC : 136
LpMDHk32 : AAGTTGGAGATGGCATCAGCTGTTACCATCAGCTCAGTCAGCGCGCAGGCCGCTTTGGTC : 135
LpMDHk33 : AAGTTGGAGATGGCATCAGCTGTTACCATCAGCTCAATCAGCGCGCAGGCCGCTTTGGTC : 135
LpMDHk34 : AAGTTGGAGATGGCATCAGCTGTTACCATCAGCTCAGTCAGCGCGCAGGCCGCTTTGGTC : 135
LpMDHk35 : AAGTTGGAGATGGCATCAGCTGTTACCATCAGTTCGGTCAGCGCGCAGTCCGCTCTGGTT : 134
LpMDHk36 : AAGTTGGAGATGGCATCAGCTGTTACCATCAGCTCAGTCAGCGCGCAGGCCGCTTTGGTC : 134
LpMDHk37 : AAGTTGGAGATGGCATCAGCTGTCACCATCAGTTCAGTCAGCGCCCAGGCCGCTCTGGTC : 127
LpMDHk38 : AAGTTGGAGATGGCATCAGCTGTCACCATCAGTTCAGTCAGCGCCCAGGCCGCTCTGGTC : 130
LpMDHk39 : AAGTTGGAGATGGCATCAGCTGTTACCATCAGCTCAGTCAGCGCGCAGGCCGCTTTGGTC : 132
LpMDHk40 : AAGTTGGAGATGGCATCAGCTGTCACCATCAGTTCAGTCAGCGCCCAGGCCGCTCTGGTC : 129
LpMDHk41 : AAGTTGGAGATGGCATCAGCTGTCACCATCAGTTCAGTCAGCGCCCAGGCCGCTCTGGTC : 130
LpMDHk42 : AAGTTGGAGATGGCATCAGCTGNACCATCAGTTCAGTCAGCGCCCAGGCCGCTCTGGTC : 126
LpMDHk43 : AAGTTGGAGATGGCATCAGCTGTTACCATCAGCTCAGTCAGCGCGCAGGCCGCTTTGGTC : 130
LpMDHk44 : AAGTTGGAGATGGCATCAGCTGTTACCATCAGCTCAGTCAGCGCGCAGGCCGCTTTGGTC : 131
LpMDHk45 : AAGTTGGAGATGGCATCAGCTGTTACCATCAGCTCAGTCAGCGCGCAGGCCGCTTTGGTC : 130
LpMDHk46 : AAGTTGGAGATGGCATCAGCTGTCACCATCAGTTCAGTCAGCGCCCAGGCCGCTCTGGTC : 128
LpMDHk47 : AAGTTGGAGATGGCATCAGCTGTTACCATCAGCTCAGTCAGCGCGCAGGCCGCTTTGGTC : 130
LpMDHk48 : AAGTTGGAGATGGCATCAGCTGTCACCATCAGTTCAGTCAGCGCCCAGGCCGCTCTGGTC : 126
LpMDHk49 : AAGTTGGAGATGGCATCAGCTGTCACCATCAGTTCAGTCAGCGCCCAGGCCGCTCTGGTC : 125
LpMDHk50 : AAGTTGGAGATGGCATCGCTGTCACCATCAGTTCAGTCAGCGCCCAGGCCGCTCTGGTC : 127
LpMDHk51 : AAGTTGGAGATGGCATCAGCTGTCACCATCAGTTCAGTCAGCGCCCAGGCCGCTCTGGTC : 126
LpMDHk52 : AAGTTGGAGATGGCATCAGCTGTCACCATCAGTTCAGTCAGCGCCCAGGCCGCTCTGGTC : 125
LpMDHk53 : AAGTTGGAGATGGCATCAGCGGTCACCATCAGTTCAGTCAGCGCCCAGGCCGCTCTGGTC : 126
LpMDHk54 : AAGTTGGAGATGGCATCAGCTGTCACCATCAGTTCAGTCAGCGCCCAGGCCGCTCTGGTC : 124
LpMDHk55 : AAGTTGGAGATGGCATCAGCTGTCACCATCAGTTCAGTCAGCGCCCAGGCCGCTCTGGTC : 123
LpMDHk56 : AAGTTGGAGATGGCATCAGCTGTCACCATCAGTTCAGTCAGCGCCCAGGCCGCTCTGGTC : 117
LpMDHk57 : AAGTTGGAGATGGCATCAGCTGTCACCATCAGTTCAGTCAGCGCCCAGGCCGCTCTGGTC : 117
LpMDHk58 : AAGTTGGAGATGGCATCAGCTGTTACCATCAGCTCAGTCAGCGCGCAGGCCGCTTTGGTC : 110
LpMDHk59 : AAGTTGGAGATGGCATCAGCTGT-ACCATCAGTT-AGT-AGCGCCCAGGCCGCTCTGGTC : 100
LpMDHk60 : AAGTTGGAGATGGCATCAGCTGTTACCATCAGCTCAGTCAGCGCGCAGGCCGCTTTGGTC : 102
LpMDHk61 : A--TTGGAGATGGCATCAGCTGTTACCATCAGCTCAGTCAGCGCGCAGGCCGCTTTGGTC : 95
LpMDHk62 : A-NTTGGAGATGGCATCAGCTGTCACCATCAGTTCAGTCAGCGCCCAGGCCGCTCTGGTC : 90
LpMDHk63 : -ANTTGGA-ATGGCATCAGCTGTCACCATCAGTTCAGTCAGCGCCCAGGCCGCTCTGGTC : 89
LpMDHk64 : AAGTTGGAGATGGCATCAGCTGTCACCATCAGTTCAGTCAGCGCCCAGGCCGCTCTGGTC : 75
LpMDHk65 : ------------------------------------------------------------ :   -
LpMDHk66 : ------------------------------------------------------------ :   -
```

FIGURE 7 (cont.)

|            |   |                                                                            |   |     |
|------------|---|----------------------------------------------------------------------------|---|-----|
|            |   | *          200          *          220          *          240             |   |     |
| LpMDHk1    | : | TCGAAACCAAGGAATCATGGCAGCACAAGCTACAGTGGCCTAAAGGCATCATCATCGTCG               | : | 238 |
| LpMDHk2    | : | TCGAAACCAAGGAATCATGGCAGCACAAGCTACAGTGGCCTAAAGGCATCATCATCGTCG               | : | 205 |
| LpMDHk3    | : | TCGAAACCAAGGAATCATGGCAGCACAAGCTTCGGTGGCCTAAAGGCATCATCGGCGTCG               | : | 206 |
| LpMDHk4    | : | TCGAAACCAAGGAATCATGGCAGCACAAGCTACAGTGGCCTAAAGGCATCATCATCGTCG               | : | 204 |
| LpMDHk5    | : | TCGAAACCAAGGAATCATGGCAGCACAAGCTACAGTGGCCTAAAGGCATCATCATCGTCG               | : | 205 |
| LpMDHk6    | : | TCGAAACCAAGGAATCATGGCAGCACAAGCTTCGGTGGCCTAAAGGCATCATCGGCGTCG               | : | 204 |
| LpMDHk7    | : | TCGAAACCAAGGAATCATGGCAGCACAAGCTACAGTGGCCTAAAGGCATCATCATCGTCG               | : | 202 |
| LpMDHk8    | : | TCGAAACCAAGGAATCATGGCAGCACAAGCTACAGTGGCCTAAAGGCATCATCATCGTCG               | : | 203 |
| LpMDHk9    | : | TCGAAACCAAGGAATCATGGCAGCACAAGCTACAGTGGCCTAAAGGCATCATCATCGTCG               | : | 203 |
| LpMDHk10   | : | TCGAAACCAAGGAATCATGGCAGCACAAGCTACAGTGGCCTAAAGGCATCATCATCGTCG               | : | 202 |
| LpMDHk11   | : | TCGAAACCAAGGAATCATGGCAGCACAAGCTTCGGTGGCCTAAAGGCATCATCGGCGTCG               | : | 201 |
| LpMDHk12   | : | TCGAAACCAAGGAATCATGGCAGCACAAGCTACAGTGGCCTAAAGGCATCATCATCGTCG               | : | 202 |
| LpMDHk13   | : | TCGAAACCAAGGAATCATGGCAGCACAAGCTACAGTGGCCTAAAGGCATCATCATCGTCG               | : | 201 |
| LpMDHk14   | : | TCGAAACCAAGGAATCATGGCAGCACAAGCTACAGTGGCCTAAAGGCATCATCATCGTCG               | : | 200 |
| LpMDHk15   | : | TCGAAACCAAGGAATCATGGCAGCACAAGCTACAGTGGCCTAAAGGCATCATCATCGTCG               | : | 199 |
| LpMDHk16   | : | TCGAAACCAAGGAATCATGGCAGCACAAGCTACAGTGGCCTAAAGGCATCATCATCGTCG               | : | 199 |
| LpMDHk17   | : | TCGAAACCAAGGAATCATGGCAGCACAAGCTACAGTGGCCTAAAGGCATCATCATCGTCG               | : | 198 |
| LpMDHk18   | : | TCGAAACCAAGGAATCATGGCAGCACAAGCTACAGTGGCCTAAAGGCATCATCATCGTCG               | : | 200 |
| LpMDHk19   | : | TCGAAACCAAGGAATCATGGCAGCACAAGCTACAGTGGCCTAAAGGCATCATCATCGTCG               | : | 200 |
| LpMDHk20   | : | TCGAAACCAAGGAATCATGGCAGCACAAGCTACAGTGGCCTAAAGGCATCATCATCGTCG               | : | 200 |
| LpMDHk21   | : | TCGAAACCAAGGAATCATGGCAGCACAAGCTACAGTGGCCTAAAGGCATCATCATCGTCG               | : | 200 |
| LpMDHk22   | : | TCGAAACCAAGGAATCATGGCAGCACAAGCTACAGTGGCCTAAAGGCATCATCATCGTCG               | : | 200 |
| LpMDHk23   | : | TCGAAACCAAGGAATCATGGCAGCACAAGCTACAGTGGCCTAAAGGCACCATCATCGTCG               | : | 197 |
| LpMDHk24   | : | TCGAAACCAAGGAATCATGGCAGCACAAGCTACAGTGGCCTAAAGGCATCATCATCGTCG               | : | 197 |
| LpMDHk25   | : | TCGAAACCAAGGAATCATGGCAGCACAAGCTACAGTGGCCTAAAGGCATCATCATCGTCG               | : | 197 |
| LpMDHk26   | : | TCGAAACCAAGGAATCGTGGCAGCACAAGCTACAGTGGCCTAAAGGCATCATCATCGTCG               | : | 199 |
| LpMDHk27   | : | TCGAAACCAAGGAATCATGGCAGCACAAGCTACAGTGGCCTAAAGGCATCATCATCGTCG               | : | 198 |
| LpMDHk28   | : | TCGAAACCAAGGAATCATGGCAGCACAAGCTACAGTGGCCTAAAGGCATCATCATCGTCG               | : | 199 |
| LpMDHk29   | : | TCGAAACCAAGGAATCATGGCAGCACAAGCTACAGTGGCCTAAAGGCATCATCATCGTCG               | : | 194 |
| LpMDHk30   | : | TCGAAACCAAGGAATCATGGCAGCACAAGCTACAGTGGCCTAAAGGCATCATCATCGTCG               | : | 198 |
| LpMDHk31   | : | TCGAAACCAAGGAATCATGGCAGCACAAGCTACAGTGGCCTAAAGGCATCATCATCGTCG               | : | 196 |
| LpMDHk32   | : | TCGAAACCAAGGAATCATGGCAGCACAAGCTACAGTGGCCTAAAGGCATCATCATCGTCG               | : | 195 |
| LpMDHk33   | : | TCGAAACCAAGGAATCATGGCAGCACAAGCTACAGTGGCCTAAAGGCATCATCATCGTCG               | : | 195 |
| LpMDHk34   | : | TCGAAACCAAGGAATCATGGCAGCACAAGCTACAGTGGCCTAAAGGCATCATCATCGTCG               | : | 195 |
| LpMDHk35   | : | TCGAAACCAAGGAATCATGGCAGCACAAGCTTCGGTGGCCTAAAGGCATCATCGGCGTCG               | : | 194 |
| LpMDHk36   | : | TCGAAACCAAGGAATCATGGCAGCACAAGCTACAGTGGCCTAAAGGCATCATCATCGTCG               | : | 194 |
| LpMDHk37   | : | TCAAAACCAAGGACTCATGGCAGCACAGCTTCAGTGGCCTAAAGGCATCATCATCGTCG                | : | 187 |
| LpMDHk38   | : | TCAAAACCAAGGAGTCATGGCAGCACAGCTTCAGTGGCCTAAAGGCATCATCATCGTCG                | : | 190 |
| LpMDHk39   | : | TCAAAACCAAGGAGTCATGGCAGCACAAGCTACAGTGGCCTAAAGGCATCATCATCGTCG               | : | 192 |
| LpMDHk40   | : | TCAAAACCAAGGAGTCATGGCAGCACAGCTTCAGTGGCCTAAAGGCATCATCATCGTCG                | : | 189 |
| LpMDHk41   | : | TCAAAACCAAGGAGTCATGGCAGCACAGCTTCAGTGGCCTAAAGGCATCATCATCGTCG                | : | 190 |
| LpMDHk42   | : | TCAAAACCAAGGAGTCATGGCAGCACAGCTTCAGTGGCCTAAAGGCATCATCATCGTCG                | : | 186 |
| LpMDHk43   | : | TCGAAACCAAGGAATCATGGCAGCACAAGCTACAGTGGCCTAAAGGCATCATCATCGTCG               | : | 190 |
| LpMDHk44   | : | TCGAAACCAAGGAATCATGGCAGCACAAGCTACAGTGGCCTAAAGGCATCATCATCGTCG               | : | 191 |
| LpMDHk45   | : | TCGAAACCAAGGAATCATGGCAGCACAAGCTACAGTGGCCTAAAGGCATCATCATCGTCG               | : | 190 |
| LpMDHk46   | : | TCAAAACCAAGGAGTCATGGCAGCACAGCTTCAGTGGCCTAAAGGCATCATCATCGTCG                | : | 188 |
| LpMDHk47   | : | TCGAAACCAAGGAATCATGGCAGCACAAGCTACAGTGGCCTAAAGGCATCATCATCGTCG               | : | 190 |
| LpMDHk48   | : | TCAAAACCAAGGAGTCATGGCAGCACAGCTTCAGTGGCCTAAAGGCATCATCATCGTCG                | : | 186 |
| LpMDHk49   | : | TCAAAACCAAGGAGTCATGGCAGCACAGCTTCAGTGGCCTAAAGGCATCATCATCGTCG                | : | 185 |
| LpMDHk50   | : | TCAAAACCAAGGAGTCATGGCAGCACAGCTTCAGTGGCCTAAAGGCATCATCATCGTCG                | : | 187 |
| LpMDHk51   | : | TCAAAACCAAGGAGTCATGGCAGCACAGCTTCAGTGGCCTAAAGGCATCATCATCGTCG                | : | 186 |
| LpMDHk52   | : | TCAAAACCAAGGAGTCATGGCAGCACAGCTTCAGTGGCCTAAAGGCATCATCATCGTCG                | : | 185 |
| LpMDHk53   | : | TCAAAACCAAGGAGTCATGGCAGCACAGCTTCAGTGGCCTAAAGGCATCATCATCGTCG                | : | 186 |
| LpMDHk54   | : | TCAAAACCAAGGAGTCATGGCAGCACAGCTTCAGTGGCCTAAAGGCATCATCATCGTCG                | : | 184 |
| LpMDHk55   | : | TCAAAACCAAGGAGTCATGGCAGCACAGCTTCAGTGGCCTAAAGGCATCATCATCGTCG                | : | 183 |
| LpMDHk56   | : | TCAAAACCAAGGAGTCATGGCAGCACAGCTTCAGTGGCCTAAAGGCATCATCATCGTCG                | : | 177 |
| LpMDHk57   | : | TCAAAACCAAGGAGTCATGGCAGCACAGCTTCAGTGGCCTAAAGGCATCATCATCGTCG                | : | 177 |
| LpMDHk58   | : | TCGAAACCAAGGAATCATGGCAGCACAAGCTACAGTGGCCTAAAGGCATCATCATCGTCG               | : | 170 |
| LpMDHk59   | : | T-AAAACCAAGGAGTCATGGCAGCACAGCTTCAGTGGCCTAAAGGCATCATCATCGTCG                | : | 159 |
| LpMDHk60   | : | TCGAAACCAAGGAATCATGGCAGCACAAGCTACAGTGGCCTAAAGGCATCATCATCGTCG               | : | 162 |
| LpMDHk61   | : | TCGAAACCAAGGAATCATGGCAGCACAAGCTACAGTGGCCTAAAGGCATCATCATCGTCG               | : | 155 |
| LpMDHk62   | : | TCAAAACCAAGGAGTCATGGCAGCACAGCTTCAGTGGCCTAAAGGCATCATCATCGTCG                | : | 150 |
| LpMDHk63   | : | TCAAAACCAAGGAGTCATGGCAGCACAGCTTCAGTGGCCTAAAGGCATCATCATCGTCG                | : | 149 |
| LpMDHk64   | : | TCAAAACCAAGGAGTCATGGCAGCACAGCTTCAGTGGCCT AAGGCATCATCATCGTCG                | : | 135 |
| LpMDHk65   | : | ------------------------------------------------------------               | : |  -  |
| LpMDHk66   | : | ------------------------------------------------------------               | : |  -  |

FIGURE 7 (cont.)

```
                    *         260         *         280         *         300
LpMDHk1  : ATCAGCTTCGAATCAGGGACATCATTCCTGGGCAAGACCACCTCTCTTCGGGCGACTATC : 298
LpMDHk2  : ATCAGCTTCGAATCAGGGACATCATTCCTGGGCAAGACCGCCTCTCTTCGGGCGACTATC : 265
LpMDHk3  : ATCAGCTTCGAATCAGGGACATCCTTCCTGGGCAAGACTGCCTCCCTCCGGGCGACTGTT : 266
LpMDHk4  : ATCAGCTTCGAATCAGGGACATCATTCCTGGGCAAGACCGCCTCTCTTCGGGCGACTATC : 264
LpMDHk5  : ATCAGCTTCGAATCAGGGACATCATTCCTGGGCAAGACCGCCTCTCTTCGGGCGACTATC : 265
LpMDHk6  : ATCAGCTTCGAATCAGGGACATCCTTCCTGGGCAAGACTGCCTCCCTCCGGGCGACTGTT : 264
LpMDHk7  : ATCAGCTTCGAATCAGGGACATCATTCCTGGGCAAGACCGCCTCTCTTCGGGCGACTATC : 262
LpMDHk8  : ATCAGCTTCGAATCAGGGACATCATTCCTGGGCAAGACCGCCTCTCTTCGGGCGACTATC : 263
LpMDHk9  : ATCAGCTTCGAATCAGGGACATCATTCCTGGGCAAGACCGCCTCTCTTCGGGCGACTATC : 263
LpMDHk10 : ATCAGCTTCGAATCAGGGACATCATTCCTGGGCAAGACCGCCTCTCTTCGGGCGACTATC : 262
LpMDHk11 : ATCAGCTTCGAATCAGGGACATCCTTCCTGGGCAAGACTGNCTCCCTCCGGGCGACTGTT : 261
LpMDHk12 : ATCAGCTTCGAATCAGGGACATCATTCCTGGGCAAGACCGCCTCTCTTCGGGCGACTATC : 262
LpMDHk13 : ATCAGCTTCGAATCAGGGACATCATTCCTGGGCAAGACCGCCTCTCTTCGGGCGACTATC : 261
LpMDHk14 : ATCAGCTTCGAATCAGGGACATCATTCCTGGGCAAGACCGCCTCTCTTCGGGCGACTATC : 260
LpMDHk15 : ATCAGCTTCGAATCAGGGACATCATTCCTGGGCAAGACCGCCTCTCTTCGGGCGACTATC : 259
LpMDHk16 : ATCAGCTTCGAATCAGGGACATCATTCCTGGGCAAGACCGCCTCTCTTCGGGCGACTATC : 259
LpMDHk17 : ATCAGCTTCGAATCAGGGACATCATTCCTGGGCAAGACCGCCTCTCTTCGGGCGACTATC : 258
LpMDHk18 : ATCAGCTTCGAATCAGGGACATCATTCCTGGGCAAGACCGCCTCTCTTCGGGCGACTATC : 260
LpMDHk19 : ATCAGCTTCGAATCAGGGACATCATTCCTGGGCAAGACCGCCTCTCTTCGGGCGACTATC : 260
LpMDHk20 : ATCAGCTTCGAATCAGGGACATCATTCCTGGGCAAGACCGCCTCTCTTCGGGCGACTATC : 260
LpMDHk21 : ATCAGCTTCGAATCAGGGACATCATTCCTGGGCAAGACCGCCTCTCTTCGGGCGACTATC : 260
LpMDHk22 : ATCAGCTTCGAATCAGGGACATCATTCCTGGGCAAGACCGCCTCTCTTCGGGCGACTATC : 260
LpMDHk23 : ATCAGCTTCGAATCAGGGACATCATTCCTGGGCAAGACCGCCTCTCTTCGGGCGACTATC : 257
LpMDHk24 : ATCAGCTTCGAATCAGGGACATCATTCCTGGGCAAGACCGCCTCTCTTCGGGCGACTATC : 257
LpMDHk25 : ATCAGCTTCGAATCAGGGACATCATTCCTGGGCAAGACCGCCTCTCTTCGGGCGACTATC : 257
LpMDHk26 : ATCAGCTTCGAATCAGGGACATCATTCCTGGGCAAGACCGCCTCTCTTCGGGCGACTATC : 259
LpMDHk27 : ATCAGCTTCGAATCAGGGACATCATTCCTGGGCAAGACCGCCTCTCTTCGGGCGACTATC : 258
LpMDHk28 : ATCAGCTTCGAATCAGGGACATCATTCCTGGGCAAGACCGCCTCTCTTCGGGCGACTATC : 259
LpMDHk29 : ATCAGCTTCGAATCAGGGACATCATTCCTGGGCAAGACCGCCTCTCTTCGGGCGACTATC : 254
LpMDHk30 : ATCAGCTTCGAATCAGGGACATCATTCCTGGGCAAGACCGCCTCTCTTCGGGCGACTATC : 258
LpMDHk31 : ATCAGCTTCGAATCAGGGACATCATTCCTGGGCAAGACCGCCTCTCTTCGGGCGACTATC : 256
LpMDHk32 : ATCAGCTTCGAATCAGGGACATCATTCCTGGGCAAGACCGCCTCTCTTCGGGCGACTATC : 255
LpMDHk33 : ATCAGCTTCGAATCAGGGACATCATTCCTGGGCAAGACCGCCTCTCTTCGGGCGACTATC : 255
LpMDHk34 : ATCAGCTTCGAATCAGGGACATCATTCCTGGGCAAGACCGCCTCTCTTCGGGCGACTATC : 255
LpMDHk35 : ATCAGCTTCGAATCAGGGACATCCTTCCTGGGCAAGACTGCCTCCCTCCGGGCGACTGTT : 254
LpMDHk36 : ATCAGCTTCGAATCAGGGACATCATTCCTGGGCAAGACCGCCTCTCTTCGGGCGACTATC : 254
LpMDHk37 : ATCAGCTTCGAATCTGGAACATCATTCCTGGGCAAGACTGCCTCTCTTCGGGCGCAGTC  : 247
LpMDHk38 : ATCAGCTTCGAATCTGGAACATCATTCCTGGGCAAGACTGCCTCTCTTCGGGCGCAGTC  : 250
LpMDHk39 : ATCAGCTTCGAATCAGGGACATCATTCCTGGGCAAGACCGCCTCTCTTCGGGCGACTATC : 252
LpMDHk40 : ATCAGCTTCGAATCTGGAACATCATTCCTGGGCAAGACTGCCTCTCTTCGGGCGCAGTC  : 249
LpMDHk41 : ATCAGCTTCGAATCTGGAACATCATTCCTGGGCAAGACTGCCTCTCTTCGGGCGCAGTC  : 250
LpMDHk42 : ATCAGCTTCGAATCTGGAACATCATTCCTGGGCAAGACTGCCTCTCTTCGGGCGCAGTC  : 246
LpMDHk43 : ATCAGCTTCGAATCAGGGACATCATTCCTGGGCAAGACCGCCTCTCTTCGGGCGACTATC : 250
LpMDHk44 : ATCAGCTTCGAATCAGGGACATCATTCCTGGGCAAGACCGCCTCTCTTCGGGCGACTATC : 251
LpMDHk45 : ATCAGCTTCGAATCAGGGACATCATTCCTGGGCAAGACCGCCTCTCTTCGGGCGACTATC : 250
LpMDHk46 : ATCAGCTTCGAATCTGGAACATCATTCCTGGGCAAGACTGCCTCTCTTCGGGCGCAGTC  : 248
LpMDHk47 : ATCAGCTTCGAATCAGGGACATCATTCCTGGGCAAGACCGCCTCTCTTCGGGCGACTATC : 250
LpMDHk48 : ATCAGCTTCGAATCTGGAACATCATTCCTGGGCAAGACTGCCTCTCTTCGGGCGCAGTC  : 246
LpMDHk49 : ATCAGCTTCGAATCTGGAACATCATTCCTGGGCAAGACTGCCTCTCTTCGGGCGCAGTC  : 245
LpMDHk50 : ATCAGCTTCGAATCTGGAGCATCATTCCTGGGCAAGACTGCCTCTCTTCGGGCGCAGTC  : 247
LpMDHk51 : ATCAGCTTCGAATCTGGAACATCATTCCTGGGCAAGACTGCCTCTCTTCGGGCGCAGTC  : 246
LpMDHk52 : ATCAGCTTCGAATCTGGAACATCATTCCTGGGCAAGACTGCCTCTCTTCGGGCGCAGGC  : 245
LpMDHk53 : ATCAGCTTCGAATCTGGAACATCATTCCTGGGCAAGACTGCCTCTCTTCGGGCGCAGTC  : 246
LpMDHk54 : ATCAGCTTCGAATCTGGAACATCATTCCTGGGCAAGACTGCCTCTCTTCGGGCGCAGTC  : 244
LpMDHk55 : ATCAGCTTCGAATCTGGAACATCATTCCTGGGCAAGACTGCCTCTCTTCGGGCGCAGTC  : 243
LpMDHk56 : ATCAGCTTCGAATCTGGAACATCATTCCTGGGCAAGACTGCCTCTCTTCGGGCGCAGTC  : 237
LpMDHk57 : ATCAGCTTCGAATCTGGAACATCATTCCTGGGCAAGACTGCCTCTCTTCGGGCGCAGTC  : 237
LpMDHk58 : ATCAGCTTCGAATCAGGGCCATCATTCCTGGCAAGACCGCTCTCTTCGGGCGACTATC   : 230
LpMDHk59 : ATCAGCTTCGAATCTGGAACATCATTCCTGGGCAAGACTGCCTCTCTTCGGGCGCAGTC  : 219
LpMDHk60 : ATCAGCTTCGAATCAGGGACATCATTCCTGGGCAAGACCGCCTCTCTTCGGGCGACTATC : 222
LpMDHk61 : ATCAGCTTCGAATCAGGGACATCATTCCTGGGCAAGACCGCCTCTCTTCGGGCGACTATC : 215
LpMDHk62 : ATCAGCTTCGAATCTGGAACATCATTCCTGGGCAAGACTGCCTCTCTTCGGGCGCAGTC  : 210
LpMDHk63 : ATCAGCTTCGAATCTGGAACATCATTCCTGGGCAAGACTGCCTCTCTTCGGGCGCAGTC  : 209
LpMDHk64 : ATCAGCTTCGAATCTGGAACATCATTCCTGGGCAAGACTGCCTCTCTTCGGGCGCAGTC  : 195
LpMDHk65 : ------------------------------------------------------------ :   -
LpMDHk66 : ------------------------------------------------------------ :   -
```

FIGURE 7 (cont.)

```
                        *         320         *         340         *         360
LpMDHk1  : ACCTCAAGGATTGTGCCAAAGGCAAAGTCTGGGTCTCAGATATCACCTCAGGCCTCGTAC : 358
LpMDHk2  : ACCTCAAGGATTGTGCCAAAGGCAAAGTCTGGGTCTCAGATATCACCTCAGGCCTCGTAC : 325
LpMDHk3  : ACCCCAAGGATTGTGCCAAAGGCAAAGTCTGGGTCTCAGATATCGCCTCAGGCATCTTAC : 326
LpMDHk4  : ACCTCAAGGATTGTGCCAAAGGCAAAGTCTGGGTCTCAGATATCACCTCAGGCCTCGTAC : 324
LpMDHk5  : ACCTCAAGGATTGTGCCAAAGGCAAAGTCTGGGTCTCAGATATCACCTCAGGCCTCGTAC : 325
LpMDHk6  : ACCCCAAGGATTGNGCCAAAGGCAAAGTCTGGGTCTCANATATCGCCTCAGGCATCTTAC : 324
LpMDHk7  : ACCTCAAGGATTGTGCCAAAGGCAAAGTCTGGGTCTCAGATATCACCTCAGGCCTCGTAC : 322
LpMDHk8  : ACCTCAAGGATTGTGCCAAAGGCAAAGCCTGGGTCTCAGATATCACCTCAGGCCTCGTAC : 323
LpMDHk9  : ACCTCAAGGATTGTGCCAAAGGCAAAGTCTGGGTCTCAGATATCACCTCAGGCCTCGTAC : 323
LpMDHk10 : ACCTCAAGGATTGTGCCAAAGGCAAAGTCTGGGTCTCAGATATCACCTCAGGCCTCGTAC : 322
LpMDHk11 : ACCCCAAGGATTGTGCCAAAGGCAAAGTCTGGGTCTCAGATATCGCCTCAGGCATCTTAC : 321
LpMDHk12 : ACCTCAAGGATTGTGCCAAAGGCAAAGTCTGGGTCTCAGATATCACCTCAGGCCTCGTAC : 322
LpMDHk13 : ACCTCAAGGATTGTGCCAAAGGCAAAGTCTGGGTCTCAGATATCACCTCAGGCCTCGTAC : 321
LpMDHk14 : ACCTCAAGGATTGTGCCAAAGGCAAAGTCTGGGTCTCAGATATCACCTCAGGCCTCGTAC : 320
LpMDHk15 : ACCTCAAGGATTGTGCCAAAGGCAAAGTCTGGGTCTCAGATATCACCTCAGGCCTCGTAC : 319
LpMDHk16 : ACCTCAAGGATTGTGCCAAAGGCAAAGTCTGGGTCTCAGATATCACCTCAGGCCTCGTAC : 319
LpMDHk17 : ACCTCAAGGATTGTGCCAAAGGCAAAGTCTGGGTCTCAGATATCACCTCAGGCCTCGTAC : 318
LpMDHk18 : ACCTCAAGGATTGTGCCAAAGGCAAAGTCTGGGTCTCAGATATCACCTCAGGCCTCGTAC : 320
LpMDHk19 : ACCTCAAGGATTGTGCCAAAGGCAAAGTCTGGGTCTCAGATATCACCTCAGGCCTCGTAC : 320
LpMDHk20 : ACCTCAAGGATTGTGCCAAAGGCAAAGTCTGGGTCTCAGATATCACCTCAGGCCTCGTAC : 320
LpMDHk21 : ACCTCAAGGATTGTGCCAAAGGCAAAGTCTGGGTCTCAGATATCACCTCAGGCCTCGTAC : 320
LpMDHk22 : ACCTCAAGGATTGTGCCAAAGGCAAAGTCTGGGTCTCAGATATCACCTCAGGCCTCGTAC : 320
LpMDHk23 : ACCTCAAGGATTGTGCCAAAGGCAAAGTCTGGGTCTCAGATATCACCTCAGGCCTCGTAC : 317
LpMDHk24 : ACCTCAAGGATTGTGCCAAAGGCAAAGTCTGGGTCTCAGATATCACCTCAGGCCTCGTAC : 317
LpMDHk25 : ACCTCAAGGATTGTGCCAAAGGCAAAGTCTGGGTCTCAGATATCACCTCAGGCCTCGTAC : 317
LpMDHk26 : ACCTCAAGGATTGTGCCAAAGGCAAAGTCTGGGTCTCAGATATCACCTCAGGCCTCGTAC : 319
LpMDHk27 : ACCTCAAGGATTGTGCCAAAGGCAAAGTCTGGGTCTCAGATATCACCTCAGGCCTCGTAC : 318
LpMDHk28 : ACCTCAAGGATTGTGCCAAAGGCAAAGTCTGGGTCTCAGATATCACCTCAGGCCTCGTAC : 319
LpMDHk29 : ACCTCAAGGATTGTGCCAAAGGCAAAGTCTGGGTCTCAGATATCACCTCAGGCCTCGTAC : 314
LpMDHk30 : ACCTCAAGGATTGTGCCAAAGGCAAAGTCTGGGTCTCAGATATCACCTCAGGCCTCGTAC : 318
LpMDHk31 : ACCTCAAGGATTGTGCCAAAGGCAAAGTCTGGGTCTCAGATATCACCTCAGGCCTCGTAC : 316
LpMDHk32 : ACCTCAAGGATTGTGCCAAAGGCAAAGTCTGGGTCTCAGATATCACCTCAGGCCTCGTAC : 315
LpMDHk33 : ACCTCAAGGATTGTGCCAAAGGCAAAGTCTGGGTCTCAGATATCACCTCAGGCCTCGTAC : 315
LpMDHk34 : ACCTCAAGGATTGTGCCAAAGGCAAAGTCTGGGTCTCAGATATCACCTCAGGCCTCGTAC : 315
LpMDHk35 : ACCCCAAGGATTGTGCCAAAGGCAAAGTCTGGGTCTCAGATATCGCCTCAGGCATCTTAC : 314
LpMDHk36 : ACCTCAAGGATTGTGCCAAAGGCAAAGTCTGGGTCTCAGATATCACCTCAGGCCTCGTAC : 314
LpMDHk37 : ACCCCCAGGATTGTGCCAAAGGCAAAGTCTGGGTCTCAGATATCGCCTCAGGCATCTTAC : 307
LpMDHk38 : ACCCCGAGGATTGTGCCAAAGGCAAAGTCTGGGTCTCAGATATCGCCTCAGGCATCTTAC : 310
LpMDHk39 : ACCTCAAGGATTGTGCCAAAGGCAAAGTCTGGGTCTCAGATATCACCTCAGGCCTCGTAC : 312
LpMDHk40 : ACCCCGAGGATTGTGCCAAAGGCAAAGTCTGGGTCTCAGATATCGCCTCAGGCATCTTAC : 309
LpMDHk41 : ACCCCGAGGATTGTGCCAAAGGCAAAGTCTGGGTCTCAGATATCGCCTCAGGCATCTTAC : 310
LpMDHk42 : ACCCCGAGGATTGTGCCAAAGGCAAAGTCTGGGTCTCAGATATCGCCTCAGGCATCTTAC : 306
LpMDHk43 : ACCTCAAGGATTGTGCCAAAGGCAAAGTCTGGGTCTCAGATATCACCTCAGGCCTCGTAC : 310
LpMDHk44 : ACCTCAAGGATTGTGCCAAAGGCAAAGTCTGGGTCTCAGATATCACCTCAGGCCTCGTAC : 311
LpMDHk45 : ACCTCAAGGATTGTGCCAAAGGCAAAGTCTGGGTCTCAGATATCACCTCAGGCCTCGTAC : 310
LpMDHk46 : ACCCCGAGGATTGTGCCAAAGGCAAAGTCTGGGTCTCAGATATCGCCTCAGGCATCTTAC : 308
LpMDHk47 : ACCTCAAGGATTGTGCCAAAGGCAAAGTCTGGGTCTCAGATATCACCTCAGGCCTCGTAC : 310
LpMDHk48 : ACCCCGAGGATTGTGCCAAAGGCAAAGTCTGGGTCTCAGATATCGCCTCAGGCATCTTAC : 306
LpMDHk49 : ACCCCGAGGATTGTGCCAAAGGCAAAGTCTGGGTCTCAGATATCGCCTCAGGCATCTTAC : 305
LpMDHk50 : ACCCCGAGGATTGTGCCAAAGGCAAAGTCTGGGTCTCAGATATCGCCTCAGGCATCTAC  : 307
LpMDHk51 : ACCCCGAGGATTGTGCCAAAGGCAAAGTCTGGGTCTCAGATATCGCCTCAGGCATCTTAC : 306
LpMDHk52 : ACCCCGAGGATTGTGCCAAAGGCAAAGTCTGGGTCTCAGATATCGCCTCAGGCATCTTAC : 305
LpMDHk53 : ACCCCGAGGATTGTGCCAAAGGCAAAGTCTGGGTCTCAGATATCCCCTCAGGCATCTTAC : 306
LpMDHk54 : ACCCCGAGGATTGTGCCAAAGGCAAAGTCTGGGTCTCAGATATCCCCTCAGGCATCTTAC : 304
LpMDHk55 : ACCCCGAGGATTGTGCCAAAGGCAAAGTCTGGGTCTCAGATATCGCCTCAGGCATCTTAC : 303
LpMDHk56 : ACCCCGAGGATTGTGCCAAAGGCAAAGTCTGGGTCTCAGATATCGCCTCAGGCATCTTAC : 297
LpMDHk57 : ACCCCGAGGATTGTGCCAAAGGCAAAGTCTGGGTCTCAGATATCGCCTCAGGCATCTTAC : 297
LpMDHk58 : ACCTCAAGGATTGTGCCAAAGGCAAAGTCTGGGTCTCAGATATCACCTCAGGCCTCGTAC : 290
LpMDHk59 : ACCCCGAGGATTGTGCCAAAGGCAAAGTCTGGGTCTCAGATATCGCCTCAGGCATCTTAC : 279
LpMDHk60 : ACCTCAAGGATTGTGCCAAAGGCAAAGTCTGGGTCTCAGATATCACCTCAGGCCTCGTAC : 282
LpMDHk61 : ACCTCAAGGATTGTGCCAAAGGCAAAGTCTGGGTCTCAGATATCACCCCAGGCCTCGTAC : 275
LpMDHk62 : ACCCCGAGGATTGTGCCAAAGGCAAAGTCTGGGTCTCAGATATCGCCTCAGGCATCTTAC : 270
LpMDHk63 : ACCCCGAGGATTGTGCCAAAGGCAAAGTCTGGGTCTCAGATATCGCCTCAGGCATCTTAC : 269
LpMDHk64 : ACCCCGAGGATTGTGCCAAAGGCAAAGTCTGGGTCTCAGATATCGCCTCAGGCATCTTAC : 255
LpMDHk65 : ------------------------------------------------------------ :  -
LpMDHk66 : ------------------------------------------------------------ :  -
```

FIGURE 7 (cont.)

```
                          *         380         *         400         *        420
LpMDHk1  : AAGGTGGCGGTGCTTGGTGCTGACGGTGGCATCGGTCAACCACTGGGCCTGCTGATCAAG : 418
LpMDHk2  : AAGGTGGCGGTGCTTGGTGCTGCCGGTGGCATCGGTCAACCACTGGGCCTGCTGATCAAG : 385
LpMDHk3  : AAGGTGGCGGTGCTTGGTGCTGCGGGTGGCATCGGCCAACCACTGGGCCTGCTGATCAAG : 386
LpMDHk4  : AAGGTGGCGGTGCTTGGTGCTGCCGGTGGCATCGGTCAACCACTGGGCCTGCTGATCAAG : 384
LpMDHk5  : AAGGTGGCGGTGCTTGGTGCTGCCGGTGGCATCGGTCAACCACTGGGCCTGCTGATCAAG : 385
LpMDHk6  : AAGCNGGCGGTGCTTGGTGCTGCGGGTGGCATCGGTCAACCACTGGGCCTGCTGATCAAN : 384
LpMDHk7  : AAGGTGGCGGTGCTTGGTGCTGCCGGTGGCATCGGTCAACCACTGGGCCTGCTGATCAAG : 382
LpMDHk8  : AAGGTGGCGGTGCTTGGTGCTGCCGGTGGCATCGGTCAACCACTGGGCCTGCTGATCAAG : 383
LpMDHk9  : AAGGTGGCGGTGCTTGGTGCTGCCGGTGGCATCGGTCAACCACTGGGCCTGCTGATCAAG : 383
LpMDHk10 : AAGGTGGCGGTGCTTGGTGCTGCCGGTGGCATCGGTCAACCACTGGGCCTGCTGATCAAG : 382
LpMDHk11 : AAGGTGGCGGTGCTTGGTGCTGCGGGTGGCATCGGTCAACCACTGGGCCTGCTGATCAAG : 381
LpMDHk12 : AAGGTGGCGGTGCTTGGTGCTGCCGGTGGCATCGGTCAACCACTGGGCCTGCTGATCAAG : 382
LpMDHk13 : AAGGTGGCGGTGCTTGGTGCTGCCGGTGGCATCGGTCAACCACTGGGCCTGCTGATCAAG : 381
LpMDHk14 : AAGGTGGCGGTGCTTGGTGCTGCCGGTGGCATCGGTCAACCACTGGGCCTGCTGATCAAG : 380
LpMDHk15 : AAGGTGGCGGTGCTTGGTGCTGCCGGTGGCATCGGTCAACCACTGGGCCTGCTGATCAAG : 379
LpMDHk16 : AAGGTGGCGGTGCTTGGTGCTGCCGGTGGCATCGGTCAACCACTGGGCCTGCTGATCAAG : 379
LpMDHk17 : AAGGTGGCGGTGCTTGGTGCTGCCGGTGGCATCGGTCAACCACTGGGCCTGCTGATCAAG : 378
LpMDHk18 : AAGGTGGCGGTGCTTGGTGCTGCCGGTGGCATCGGTCAACCACTGGGCCTGCTGATCAAG : 380
LpMDHk19 : AAGGTGGCGGTGCTTGGTGCTGCCGGTGGCATCGGTCAACCACTGGGCCTGCTGATCAAG : 380
LpMDHk20 : AAGGTGGCGGTGCTTGGTGCTGCCGGTGGCATCGGTCAACCACTGGGCCTGCTGATCAAG : 380
LpMDHk21 : AAGGTGGCGGTGCTTGGTGCTGCCGGTGGCATCGGTCAACCACTGGGCCTGCTGATCAAG : 380
LpMDHk22 : AAGGTGGCGGTGCTTGGTGCTGCCGGTGGCATCGGTCAACCACTGGGCCTGCTGATCAAG : 380
LpMDHk23 : AAGGTGGCGGTGCTTGGTGCTGCCGGTGGCATCGGTCAACCACTGGGCCTGCTGATCAAG : 377
LpMDHk24 : AAGGTGGCGGTGCTTGGTGCTGCCGGTGGCATCGGTCAACCACTGGGCCTGCTGATCAAG : 377
LpMDHk25 : AAGGTGGCGGTGCTGTTGGTGCTGCCGGTGGCATCGGTCAACCACTGGGCCTGCTGATCAAG : 377
LpMDHk26 : AAGGTGGCGGTGCTTGGTGCTGCCGGTGGCATCGGTCAACCACTGGGCCTGCTGATCAAG : 379
LpMDHk27 : AAGGTGGCGGTGCTTGGTGCTGCCGGTGGCATCGGTCAACCACTGGGCCTGCTGACCAAG : 378
LpMDHk28 : AAGGTGGCGGTGCTTGGTGCTGCCGGTGGCATCGGTCAACCACTGGGCCTGCTGATCAAG : 379
LpMDHk29 : AAGGTGGCGGTGCTTGGTGCTGCCGGTGGCATCGGTCAACCACTGGGCCTGCTGATCAAG : 374
LpMDHk30 : AAGGTGGCGGTGCTTGGTGCTGCCGGTGGCATCGGTCAACCACTGGGCCTGCTGATCAAG : 378
LpMDHk31 : AAGGTGGCGGTGCTTGGTGCTGCCGGTGGCATCGGTCAACCACTGGGCCTGCTGATCAAG : 376
LpMDHk32 : AAGGTGGCGGTGCTTGGTGCTGCCGGTGGCATCGGTCAACCACTGGGCCTGCTGATCAAG : 375
LpMDHk33 : AAGGTGGCGGTGCTTGGTGCTGCCGGTGGCATCGGTCAACCACTGGGCCTGCTGATCAAG : 375
LpMDHk34 : AAGGTGGCGGTGCTTGGTGCTGCCGGTGGCATCGGTCAACCACTGGGCCTGCTGATCAAG : 375
LpMDHk35 : AAGGTGGCGGTGCTTGGTGCTGCGGGTGGCATCGGTCAACCACTGGGCCTGCTGATCAAG : 374
LpMDHk36 : AAGGTGGCGGTGCTTGGTGCTGCCGGTGGCATCGGTCAACCACTGGGCCTGCTGATCAAG : 374
LpMDHk37 : AAGGTGGCGGTGCTTGGTGCTGCCGGTGGCATCGGTCAACCACTGGGCCTGCTGATCAAG : 367
LpMDHk38 : AAGGTGGCGGTGCTTGGTGCTGCCGGTGGCATCGGTCAACCACTGGGCCTGCTGATCAAG : 370
LpMDHk39 : AAGGTGGCGGTGCTTGGTGCTGCCGGTGGCATCGGTCAACCACTGGGCCTGCTGATCAAG : 372
LpMDHk40 : AAGGTGGCGGTGCTTGGTGCTGCCGGTGGCATCGGTCAACCACTGGGCCTGCTGATCAAG : 369
LpMDHk41 : AAGGTGGCGGTGCTTGGTGCTGCCGGTGGCATCGGTCAACCACTGGGCCTGCTGATCAAG : 370
LpMDHk42 : AAGGTGGCNGGTGCTTGGTGCTGCGGGTGGCATCGGTCAACCACTGGGCCTGCTGATCAAG : 366
LpMDHk43 : AAGGTGGCGGTGCTTGGTGCTGCCGGTGGCATCGGTCAACCACTGGGCCTGCTGATCAAG : 370
LpMDHk44 : AAGGTGGCGGTGCTTGGTGCTGCCGGTGGCATCGGTCAACCACTGGGCCTGCTGATCAAG : 371
LpMDHk45 : AAGGTGGCGGTGCTTGGTGCTGCCGGTGGCATCGGTCAACCACTGGGCCTGCTGATCAAG : 370
LpMDHk46 : AAGGTGGCGGTGCTTGGTGCTGCCGGTGGCATCGGTCAACCACTGGGCCTGCTGATCAAG : 368
LpMDHk47 : AAGGTGGCGGTGCTTGGTGCTGCCGGTGGCATCGGTCAACCACTGGGCCTGCTGATCAAG : 370
LpMDHk48 : AAGGTGGCGGTGCTTGGTGCTGCCGGTGGCATCGGTCAACCACTGGGCCTGCTGATCAAG : 366
LpMDHk49 : AAGGTGGCGGTGCTTGGTGCTGCCGGTGGCATCGGTAACCACTGGGCCTGCTGATCAAG : 365
LpMDHk50 : AAGGTGGCGGTGCTTGGTGCTGCCGGTGGCATCGGTCAACCACTGGGCCTGCTGATCAAG : 367
LpMDHk51 : AAGGTGGCGGTGCTTGGTGCTGCCGGTGGCATCGGTCAACCACTGGGCCTGCTGATCAAG : 366
LpMDHk52 : AAGGTGGCGGTGCTTGGTGCTGCCGGTGGCATCGGTCAACCACTGGGCCTGCTGATCAAG : 365
LpMDHk53 : AAGGTGGCGGTGCTTGGTGCTGCCGGTGGCATCGGTCAACCACTGGGCCTGCTGATCAAG : 366
LpMDHk54 : AAGGTGGCGGTGCTTGGTGCTGCCGGTGGCATCGGTCAACCACTGGGCCTGCTGATCAAG : 364
LpMDHk55 : AAGGTGGCGGTGCTTGGTGCTGCCGGTGGCATCGGTCAACCACTGGGCCTGCTGATCAAG : 363
LpMDHk56 : AAGGTGGCGGTGCTTGGTGCTGCCGGTGGCATCGGTCAACCACTGGGCCTGCTGATCAAG : 357
LpMDHk57 : AAGGTGGCGGTGCTTGGTGCTGCCGGTGGCATCGGTCAACCACTGGGCCTGCTGATCAAG : 357
LpMDHk58 : AAGGTGGCGGTGCTTGGTGCTGCCGGTGGCATCGGTCAACCACTGGGCCTGCTGATCAAG : 350
LpMDHk59 : AAGGTGGCGGTGCTTGGTGCTGCGGGTGGCATCGGTCAACCACTGGGCCTGCTGATCAAG : 339
LpMDHk60 : AAGGTGGCGGTGCTTGGTGCTGCCGGTGGCATCGGTCAACCACTGGGCCTGCTGATCAAG : 342
LpMDHk61 : AAGGTGGCGGTGCTTGGTGCTGCCGGTGGCATCGGTCAACCACTGGGCCTGCTGATCAAC : 335
LpMDHk62 : AAGGTGGCGGNGCTTGGTGCTGNCGGNGGCATNGGCCAACCACTGGGCCTGCTGATNAAG : 330
LpMDHk63 : AAGGTGGCGGTGCTTGGTGCTGCCGGTGGCATCGGTCAACCACTGGGCCTGCTGATCAAG : 329
LpMDHk64 : AAGGTGGCGGTGCTTGGTGCTGCCGGTGGCATCGGTCAACCACTGGGCCTGCTGATCAAG : 315
LpMDHk65 : -----------TTGGTGCTGCGGGTGGCATCGGTCAACCACTGGGCCTGCTGATCAAG :  47
LpMDHk66 : ------------------------------------------------------------ :   -
```

FIGURE 7 (cont.)

```
              *         440         *         460         *         480
LpMDHk1  : ATGTCTCCTCTGGTCTCAGAGCTGCGCCTGTATGATATTGACAATGTCAAGGGAGTCGCT : 478
LpMDHk2  : ATGTCTCCTCTGGTCTCAGAGCTGCGCCTGTATGATATTGCCAATGTCAAGGGAGTCGCT : 445
LpMDHk3  : ATGTCTCCTCTAGTCTCAGAGCTGCGCCTGTATGATATTGCCAATGTCAAGGGCGTCGCT : 446
LpMDHk4  : ATGTCTCCTCTGGTCTCAGAGCTGCGCCTGTATGATATTGCCAATGTCAAGGGAGTCGCT : 444
LpMDHk5  : ATGTCTCCTCTGGTCTCAGAGCTGCGCCTGTATGATATTGCCAATGTCAAGGGAGTCGCT : 445
LpMDHk6  : ATGTCTCCTCTGGTCTCAN----------------------------------------- : 403
LpMDHk7  : ATGTCTCCTCTGGTCTCAGAGCTGCGCCTGTATGATATTGCCAATGTCAAGGGAGTCGCT : 442
LpMDHk8  : ATGTCTCCTCTGGTCTCAGAGCTGCGCCTGTATGATATTGCCAATGTCAAGGGAGTCGCT : 443
LpMDHk9  : ATGTCTCCTCTGGTCTCAGAGCTGCGCCTGTATGATATTGCCAATGTCAAGGGAGTCGCT : 443
LpMDHk10 : ATGTCTCCTCTGGTCTCAGAGCTGCGCCTGTATGATATTGCCAATGTCAAGGGAGTCGCT : 442
LpMDHk11 : ATGTCTCCTCTGGTCTCAGAGCTGCGCCTGTATGATATTGCCAATGTCAAGGGCGTCGCT : 441
LpMDHk12 : ATGTCTCCTCTGGTCTCAGAGCTGCGCCTGTATGATATTGCCAATGTCAAGGGAGTCGCT : 442
LpMDHk13 : ATGTCTCCTCTGGTCTCAGAGCTGCGCCTGTATGATATTGCCAATGTCAAGGGAGTCGCT : 441
LpMDHk14 : ATGTCTCCTCTGGTCTCAGAGCTGCGCCTGTATGATATTGCCAATGTCAAGGGAGTCGCT : 440
LpMDHk15 : ATGTCTCCTCTGGTCTCAGAGCTGCGCCTGTATGATATTGCCAATGTCAAGGGAGTCGCT : 439
LpMDHk16 : ATGTCTCCTCTGGTCTCAGAGCTGCGCCTGTATGATATTGCCAATGTCAAGGGAGTCGCT : 439
LpMDHk17 : ATGTCTCCTCTGGTCTCAGAGCTGCGCCTGTATGATATTGCCAATGTCAAGGGAGTCGCT : 438
LpMDHk18 : ATGTCTCCTCTGGTCTCAGAGCTGCGCCTGTATGATATTGCCAATGTCAAGGGAGTCGCT : 440
LpMDHk19 : ATGTCTCCTCTGGTCTCAGAGCTGCGCCTGTATGATATTGCCAATGTCAAGGGAGTCGCT : 440
LpMDHk20 : ATGTCTCCTCTGGTCTCAGAGCTGCGCCTGTATGATATTGCCAATGTCAAGGGAGTCGCT : 440
LpMDHk21 : ATGTCTCCTCTGGTCTCAGAGCTGCGCCTGTATGATATTGCCAATGTCAAGGGAGTCGCT : 440
LpMDHk22 : ATGTCTCCTCTGGTCTCAGAGCTGCGCCTGTATGATATTGCCAATGTCAAGGGAGTCGCT : 440
LpMDHk23 : ATGTCTCCTCTGGTCTCAGAGCTGCGCCTGTATGATATTGCCAATGTCAAGGGAGTCGCT : 437
LpMDHk24 : ATGTCTCCTCTGGTCTCAGAGCTGCGCCTGTATGATATTGCCAATGTCAAGGGAGTCGCT : 437
LpMDHk25 : ATGTCTCCTCTGGTCTCAGAGCTGCGCCTGTATGATATTGCCAATGTCAAGGGAGTCGCT : 437
LpMDHk26 : ATGTCTCCTCTGGTCTCAGAGCTGCGCCTGTATGATATTGCCAATGTCAAGGGAGTCGCT : 439
LpMDHk27 : ATGTCTCCTCTGGTCTCAGAGCTGCGCCTGTATGATATTGCCAATGTCAAGGGAGTCGCT : 438
LpMDHk28 : ATGTCTCCTCTGGTCTCAGAGCTGCGCCTGTATGATATTGCCAATGTCAAGGGAGTCGCT : 439
LpMDHk29 : ATGTCTCCTCTGGTCTCAGANCTGCGCCTGTATGATATTGCCAATGTCAAGGGAGTCGCT : 434
LpMDHk30 : ATGTCTCCTCTGGTCTCAGAGCTGCGCCTGTATGATATTGCCAATGTCAAGGGAGTCGCT : 438
LpMDHk31 : ATGTCTCCTCTGGTCTCAGAGCTGCGCCTGTATGATATTGCCAATGTCAAGGGAGTCGCT : 436
LpMDHk32 : ATGTCTCCTCTGGTCTCAGAGCTGCGCCTGTATGATATTGCCAATGTCAAGGGAGTCGCT : 435
LpMDHk33 : ATGTCTCCTCTGGTCTCAGAGCTGCGCCTGTATGATATTGCCAATGTCAAGGGAGTCGCT : 435
LpMDHk34 : ATGTCTCCTCTGGTCTCAGAGCTGCGCCTGTATGATATTGCCAATGTCAAGGGAGTCGCT : 435
LpMDHk35 : ATGTCTCCTCTGGTCTCANAGCTGCGCCTGTATGATATTGCCAATGTCAAGGGCGTCGCT : 434
LpMDHk36 : ATGTCTCCTCTGGTCTCAGAGCTGCGCCTGTATGATATTGCCAATGTCAAGGGAGTCGCT : 434
LpMDHk37 : ATGTCCCCTCTGGTCTCGGAGCTGCGCCTGTATGATATTGCCAATGTCAAGGGCGTCGCT : 427
LpMDHk38 : ATGTCCCCTCTGGNCTCGGAGCTGCGCCTGTATGATATTGCCAATGTCAAGGGCGTCGCT : 430
LpMDHk39 : ATGTCTCCTCTGGTCTCGGAGCTGCGCCTGTATGATATTGCCAATGTCAAGGGAGTCGCT : 432
LpMDHk40 : ATGTCCCCTCTGGTCTCGGAGCTGCGCCTGTATGATATTGCCAATGTCAAGGGCGTCGCT : 429
LpMDHk41 : ATGTCCCCTCTGGTCTCGGAGCTGCGCCTGTATGATATTGCGAATGTCAAGGGCGTCGCT : 430
LpMDHk42 : ATGTCCCCTCTGGTCTCGGAGCTGCGCCTGTATGATATTGCCAATGTCAAGGGCGTCGCT : 426
LpMDHk43 : ATGTCTCCTCTGGTCTCAGAGCTGCGCCTGTATGATATTGCCAATGTCAAGGGAGTCGCT : 430
LpMDHk44 : ATGTCTCCTCTGGTCTCAGAGCTGCGCCTGTATGATATTGCCAATGTCAAGGGAGTCGCT : 431
LpMDHk45 : ATGTCTCCTCTGGTCTCAGAGCTGCGCCTGTATGATATTGCCAATGTCAAGGGAGTCGCT : 430
LpMDHk46 : ATGTCCCCTCTGGTCTCGGAGCTGCGCCTGTATGATATTGCGAATGTCAAGGGCGTCGCT : 428
LpMDHk47 : ATGTCTCCTCTGGTCTCAGAGCTGCGCCTGTATGATATTGCCAATGTCAAGGGAGTCGCT : 430
LpMDHk48 : ATGTCCCCTCTGGTCTCGGAGCTGCGCCTGTATGATATTGCCAATGTCAAGGGCGTCGCT : 426
LpMDHk49 : ATGTCCCCTCTGGTCTCGGAGCTGCGCCTGTATGATATTGCGAATGTCAAGGGCGTCGCT : 425
LpMDHk50 : ATGTCCCCTCTGGTCTCGGAGCTGCGCCTGTATGATATTGCGAATGTCAAGGGCGTCGCT : 427
LpMDHk51 : ATGTCCCCTCTGGTCTCGGAGCTGCGCCTGTATGATATTGCCAATGTCAAGGGCGTCGCT : 426
LpMDHk52 : ATGTCCCCTCTGGTCTCGGAGCTGCGCCTGTATGATATTGCGAATGTCAAGGGCGTCGCT : 425
LpMDHk53 : ATGTCCCCTCTGGTCTCGGAGCTGCGCCTGTATGATATTGCCAATGTCAAGGGCGTCGCT : 426
LpMDHk54 : ATGTCCCCTCTGGTCTCGGAGCTGCGCCTGTATGATATTGCGAATGTCAAGGGCGTCGCT : 424
LpMDHk55 : ATGTCCCCTCTGGTCTCGGAGCTGCGCCTGTATGATATTGCGAATGTCAAGGGCGTCGCT : 423
LpMDHk56 : ATGTCCCCTCTGGTCTCGGAGCTGCGCCTGTATGATATTGCGAATGTCAAGGGCGTCGCT : 417
LpMDHk57 : ATGTCCCCTCTGGTCTCGGAGCTGCGCCGTATGATANTGCGAATGTCAAGGGCGTCGCT : 417
LpMDHk58 : ATGNNTCCTCTGGTCTCANAGCTGCGCCTGTATGATATTGCCAATGNCAAGGGAGTCGCT : 410
LpMDHk59 : ATGTCTCCTCTGGTCTCAGAGCTGCGCCTGTATGATATTGCCAATGTCAAGGGCGTCGCT : 399
LpMDHk60 : ATGTCTCCTCTGGTCTCAGAGCTGCGCCTGTATGATATTGCCAATGTCAAGGGAGTCGCT : 402
LpMDHk61 : ATGTCTCCTCTGGTCTCAGAGCTGCGCCTGTATGATATTGCCAATGTCAAGGGAGTCGCT : 395
LpMDHk62 : ATG--------------------------------------------------------- : 333
LpMDHk63 : ATGTCCCCTCTGGTCTCGGAGCTGCGCCTGTATGATATTGCGAATGTCAAGGGCGTCGCT : 389
LpMDHk64 : ATGTCCCCTCTGGTCTCGGAGCTGCGCCTGTATGATATTGCGAATGTCAAGGGCGTCGCT : 375
LpMDHk65 : ATGTCTCCTCTCGTCTCGGAGCTGCGCCTGTATGATATGGCCAATGTCAAGGGAGTCGCT : 107
LpMDHk66 : ------------------------------------------------------------ :   -
```

FIGURE 7 (cont.)

|  | | * | 500 | * | 520 | * | 540 | | |
|---|---|---|---|---|---|---|---|---|---|
| LpMDHk1 | : | GCAGATCTCAGNCACTGCAACACGCCTTCTCAGGTCATGGACTTCACTGGCCCAGCAGAA | : | 538 |
| LpMDHk2 | : | GCAGATCTCAGCCACTGCAACACGCCTTCTCAGGTCATGGACTTCACTGGCCCAGCAGAA | : | 505 |
| LpMDHk3 | : | GCAGATCTTAGCCACTGCAACACGCCTTCTCAGGTCATGGACTTCACTGGCCCGGCGGAA | : | 506 |
| LpMDHk4 | : | GCAGATCTCAGCCACTGCAACACGCCTTCTCAGGTCATGGACTTCACTGGCCCAGCAGAA | : | 504 |
| LpMDHk5 | : | GCAGATCTCAGCCACTGCAACACGCCTTCTCAGGTCATGGACTTCACTGGCCCAGCAGAA | : | 505 |
| LpMDHk6 | : | ------------------------------------------------------------ | : | - |
| LpMDHk7 | : | GCAGATCTCAGCCACTGCAACACGCCTTCTCAGGTCATGGACTTCACTGGCCCAGCAGAA | : | 502 |
| LpMDHk8 | : | GCAGATCTCAGCCACTGCAACACGCCTTCTCAGGTCATGGACTTCACTGGCCCAGCAGAA | : | 503 |
| LpMDHk9 | : | GCAGATCTCAGCCACTGCAACACGCCTTCTCAGGTCATGGACTTCACTGGCCCAGCAGAA | : | 503 |
| LpMDHk10 | : | GCAGATCTCAGCCACTGCAACACGCCTTCTCAGGTCATGGACTTCACTGGCCCAGCAGAA | : | 502 |
| LpMDHk11 | : | GCAGATCTTAGCCACTGCAACACGCCTTCTCAGGTCATGGACTTCACTGGCCCGGCGGAA | : | 501 |
| LpMDHk12 | : | GCAGATCTCAGCCACTGCAACACGCCTTCTCAGGTCATGGACTTCACTGGCCCAGCAGAA | : | 502 |
| LpMDHk13 | : | GCAGATCTCAGCCACTGCAACACGCCTTCTCAGGTCATGGACTTCACTGGCCCAGCAGAA | : | 501 |
| LpMDHk14 | : | GCAGATCTCAGCCACTGCAACACGCCTTCTCAGGTCATGGACTTCACTGGCCCAGCAGAA | : | 500 |
| LpMDHk15 | : | GCAGATCTCAGCCACTGCAACACGCCTTCTCAGGTCATGGACTTCACTGGCCCAGCAGAA | : | 499 |
| LpMDHk16 | : | GCAGATCTCAGCCACTGCAACACGCCTTCTCAGGTCATGGACTTCACTGGCCCAGCAGAA | : | 499 |
| LpMDHk17 | : | GCAGATCTCAGCCACTGCAACACGCCTTCTCAGGTCATGGACTTCACTGGCCCAGCAGAA | : | 498 |
| LpMDHk18 | : | GCAGATCTCAGCCACTGCAACACGCCTTCTCAGGTCATGGACTTCACTGGCCCAGCAGAA | : | 500 |
| LpMDHk19 | : | GCAGATCTCAGCCACTGCAACACGCCTTCTCAGGTCATGGACTTCACTGGCCCAGCGAA | : | 500 |
| LpMDHk20 | : | GCAGATCTCAGCCACTGCAACACGCCTTCTCAGGTCATGGACTTCACTGGCCCAGCAGAA | : | 500 |
| LpMDHk21 | : | GCAGATCTCAGCCACTGCAACACGCCTTCTCAGGTCATGGACTTCACTGGCCCAGCAGAA | : | 500 |
| LpMDHk22 | : | GCAGATCTCAGCCACTGCAACACGCCTTCTCAGGTCATGGACTTCACTGGCCCAGCAGAA | : | 500 |
| LpMDHk23 | : | GCAGATCTCAGCCACTGCAACACGCCTTCTCAGGTCATGGACTTCACTGGCCCAGCAGAA | : | 497 |
| LpMDHk24 | : | GCAGATCTCAGCCCTGCAACACGCCTTCTCAGGTCATGGACTTCACTGGCCCAGCAGAA | : | 497 |
| LpMDHk25 | : | GCAGATCTCAGCCACTGCAACACGCCTTCTCAGGTCATGGACTTCACTGGCCCAGCAGAA | : | 497 |
| LpMDHk26 | : | GCAGATCTCAGCCACTGCAACACGCCTTCTCAGGTCATGGACTTCACTGGCCCAGCAGAA | : | 499 |
| LpMDHk27 | : | GCAGTCTCAGCCACTGCAACACGCCTTCTCAGGTCATGGACTTCACTGGCCAGCAGAA | : | 498 |
| LpMDHk28 | : | GCAGATCTCAGCCACTGCAACACGCCTTCTCAGGTCATGGACTTCACTGGCCCAGCAGAA | : | 499 |
| LpMDHk29 | : | GCAGATCTCAGCCACTGCAACACGCCTTCTCAGGTCATGGACTTCCTGGCCCAGCAGAA | : | 494 |
| LpMDHk30 | : | GCAGATCTCAGCCACTGCAACACGCCTTCTCAGGTCATGGACTTCACTGGCCCAGCAGAA | : | 498 |
| LpMDHk31 | : | GCAGATCTCAGCCACTGCAACACGCCTTCTCAGGTCATGGACTTCACTGGCCCAGCAGAA | : | 496 |
| LpMDHk32 | : | GCAGATCTCAGCCACTGCAACACGCCTTCTCAGGTCATGGACTTCACTGGCCCAGCAGAA | : | 495 |
| LpMDHk33 | : | GCAGATCTCAGCCACTGCAACACGCCTTCTCAGGTCATGGACTTCACTGGCCCAGCAGAA | : | 495 |
| LpMDHk34 | : | GCAGATCTCAGCCACTGCAACACGCCTTCTCAGGTCATGGACTTCACTGGCCCAGCAGAA | : | 495 |
| LpMDHk35 | : | GCAGATCTTAGCCACTGCAACACGCCTTCTCAGGTCATGGACTTCACTGGCCCGGCGGAA | : | 494 |
| LpMDHk36 | : | GCAGATCTCAGCCACTGCAACACGCCTTCTCAGGTCATGGACTTCACTGGCCCAGCAGAA | : | 494 |
| LpMDHk37 | : | GCCGATCTCAGCCACGCAACACGCCTCTCAGGTCATGGACTTCACTGGCCCGGCGGAA | : | 487 |
| LpMDHk38 | : | GCCGATCTCAGCCACTGCAACACGCCTCTCAGGTCATGGACTTCACTGGCCCGGCGGAA | : | 490 |
| LpMDHk39 | : | GCAGATCTCAGCCACTGCAACACGCCTTCTCAGGTCATGGACTTCACTGGCCCAGCAGAA | : | 492 |
| LpMDHk40 | : | GCCGATCTCAGCCACTGCAACACGCCTCTCAGGTCATGGACTTCACTGGCCCGGCGAA | : | 489 |
| LpMDHk41 | : | GCCGATCTCAGCCACTGCAACACGCCTGCTCGGTCATGGACTTCACTGGCCCGGCGAA | : | 490 |
| LpMDHk42 | : | GCAGATCTTAGCCACTGCAACACGCCTTCTCAGGTCATGGACTTCACTGGCCCGGCGGAA | : | 486 |
| LpMDHk43 | : | GCAGATCTCAGCCACTGCAACACGCCTTCTCAGGTCATGGACTTCACTGGCCCAGCAGAA | : | 490 |
| LpMDHk44 | : | GCAGATCTCAGCCACTGCAACACGCCTTCTCAGGTCATGGACTTCACTGGCCCAGCAGAA | : | 491 |
| LpMDHk45 | : | GCAGATCTCAGCCACTGCAACACGCCTTCTCAGGTCATGGCTTCACTGGCCCAGCAGAA | : | 490 |
| LpMDHk46 | : | GCCGATCTCAGCCACTGCAACACGCCTCTCAGGTCATGGACTTCACTGGCCCGGCGAA | : | 488 |
| LpMDHk47 | : | GCAGATCTCAGCCACTGCAACACGCCTTCTCAGGTCATGGACTTCACTGGCCCAGCAGAA | : | 490 |
| LpMDHk48 | : | GCCGACTCAGCCACTGCAACACGCCTCTCAGGTCATGGACTTCACTGGCCCGGCGAA | : | 486 |
| LpMDHk49 | : | GCCGATCTCAGCCACTGCAACACGCCTCTCAGGTCATGGACTTCACTGGCCCGGCGAA | : | 485 |
| LpMDHk50 | : | GCCGATCTCAGCCACTGCAACACGCCTCTCAGGTCATGGACTTCACTGGCCCGGCGAA | : | 487 |
| LpMDHk51 | : | GCCGATCTCAGCCACTGCAACACGCCTGCTCAGGTCATGGACTTCACTGGCCCGGCGAA | : | 486 |
| LpMDHk52 | : | GCCGATCTCAGCCACTGCAACACGCCTCTCAGGTCATGGACTTCACTGGCCCGGCGAA | : | 485 |
| LpMDHk53 | : | GCCGATCTCAGCCACTGCAACACGCCTGCTCAGGTCATGGACTTCACTGGCCCGGCGAA | : | 486 |
| LpMDHk54 | : | GCCGATCTCAGCCACTGCAACACGCCTCTCAGGTCATGGACTTCACTGGCCCGGCGAA | : | 484 |
| LpMDHk55 | : | GCCGATCTCAGCCACTGCAACACGCCTGCTCAGGTCATGGACTTCACTGGCCCGGCGAA | : | 483 |
| LpMDHk56 | : | GCCGATCTCAGCCACTGCAACACACGCCTCTCAGGTCATGGACTTCACTGGCCCGGCGAA | : | 477 |
| LpMDHk57 | : | GCCGATCTCAGCCACTGCAACACGCCTCTCAGGTCATGGACTTCACTGGCCCGGCGAA | : | 477 |
| LpMDHk58 | : | GCAZATCTCAMNCACTGCAACACGCCTTCTNAGGNCATGGACTTCACTGGNCCANCANAA | : | 470 |
| LpMDHk59 | : | GCAGATCTTAGCCACTGCAACACGCCTTCTCAGGTCATGGACTTCACTGGCCCGGCGGAA | : | 459 |
| LpMDHk60 | : | GCAGATCTCAGCCACTGCAACACGCCTTCTCAGGTCATGGACTTCACTGGCCCAGCAGAA | : | 462 |
| LpMDHk61 | : | GCAGATCTCAGCCACTGCAACACGCCTTCTCAGGTCATGGACTTCACTGGCCCAGCAGAA | : | 455 |
| LpMDHk62 | : | ------------------------------------------------------------ | : | - |
| LpMDHk63 | : | GCCGATCTCAGCCACTGCAACACGCCTCTCAGGTCATGGACTTCACTGGCCCGGCGAA | : | 449 |
| LpMDHk64 | : | GCCGATCTCAGCCACTGCAACACGCCTCTCAGGTCATGGACTTCACTGGCCCGGCGAA | : | 435 |
| LpMDHk65 | : | GCAGATCTCAGCCACTGCAACACGCCTCTCACGCATGGACTTCACTGGCCCGGCGAA | : | 167 |
| LpMDHk66 | : | -----GTCAGCC.CTGCAACACGCCTCTCAGGCATGGACTTCACTGGCCCGGCGGAA | : | 54 |

|          | 680 / 700 / 720 | |
|---|---|---|
| LpMDHk1  | GAGGCTGTTGCAGACAACTGCCCTGAGGCCTTCATCCATATCATCANCNACCC------ | : 711 |
| LpMDHk2  | GAGGCTGTTGCAGACAACTGCC-------------------------------------- | : 647 |
| LpMDHk3  | GAGGCTGTTGCAGACAACTGCCCTGAGGCCTTCATCCATATCATCAGCAACCCGGTCAAC | : 686 |
| LpMDHk4  | GAGGCTGNTGCAGACAACTGCCCTGAGGCCTTCATCCATATCATCAGCAACCCGGTCAAC | : 684 |
| LpMDHk5  | GAGGCTGTTGCAGACAACTGCCCTGAGGCCTTCATCCATATCATCAGCAACCCGGTCAAC | : 685 |
| LpMDHk6  | ------------------------------------------------------------ | : - |
| LpMDHk7  | ------------------------------------------------------------ | : - |
| LpMDHk8  | GAGGCTGTTGCAGACAACTCCCCTGAGGCCTTCATC------------------------ | : 659 |
| LpMDHk9  | GAGGCTGTTGCAGACAACTGCCCTGAGGCCTTCATCCATATCATCAGCAACCCGGTCAAC | : 683 |
| LpMDHk10 | GAGGCTGTTGCAGACAACTGCCCTGAGGCCTTCATCCATATCATCAGCAACCCGGTCAAC | : 682 |
| LpMDHk11 | GAGGCTGTTGCAGACAACTGCCCTGAGGCCTTCATCCATATCATCAGCAACCCGGTCAAC | : 681 |
| LpMDHk12 | GAGGCTGTTGCAGACAACTGCCCTGAGGCCTTCATNCATATCATCAGCAACCCGGTCAAC | : 682 |
| LpMDHk13 | GAGGCTGNTGCAGACAACTGCCCTGAGGCCTTCATCCATATCATCAGCAACCCGGTCAAC | : 681 |
| LpMDHk14 | GAGGCTGTTGCAGACAACTGCCCTGACGCCTTCATNCATATCATCAGCAACCCGGTCACN | : 680 |
| LpMDHk15 | GAGGCTGTTGCAGACAACTGCCCTGAGGCCTTCATCCATATCATCAGCAACCCGGTCAAC | : 679 |
| LpMDHk16 | GAGGCTGNTGCAGACAACTGCCCTGAGGCCTTCATCCATATCATCAGCAACCCGGTCAAC | : 679 |
| LpMDHk17 | GAGGCTGTTGCAGACA-------------------------------------------- | : 634 |
| LpMDHk18 | GAGGCTGTTGCAGACAACTGCCCTGAGGCCTTCATCCATATCATCAGCAACCCGGTCAAC | : 680 |
| LpMDHk19 | GAGGCTGNTGCAGACAACTGCCCTGAGGCCTTCATCCATATCATCAGCAACCCGGNCAAC | : 680 |
| LpMDHk20 | GAGGCTGTTGCAGACAACTGCCCTGAGGCCTTCATCCATATCATCAGCAACCCGGTCAAC | : 680 |
| LpMDHk21 | GAGGCTGTTGCAGACAACTGCCCTGAGGCCTTCATCCATATCATCAGCAACCCGGTCAAC | : 680 |
| LpMDHk22 | GAGGCTGTTGCAGACAACTGCCCTGAGGCCTTCATCCATATCATCAGCAACCCGGTCAAC | : 680 |
| LpMDHk23 | GAGGCTGTTGC------------------------------------------------- | : 628 |
| LpMDHk24 | GAGGCTGTTGCAGACAACTGCCC------------------------------------- | : 640 |
| LpMDHk25 | GAGGCTGTTGCAGACAACTGCCCTGAGGCCTTCATCCATATCATCAGCAACCCGGTCAAC | : 677 |
| LpMDHk26 | GAGGCTGNTGCAGACAACTGCCCTGAGGCCTTCATNCATATCATCAGCAACCCGGTCAAC | : 679 |
| LpMDHk27 | GAGGCTGTTGCAGACAACTGCCCTGAGGCCTTCATCCATATCATCAGCAACCCGGTCAAC | : 678 |
| LpMDHk28 | GAGGCTGTTGCAGACAACTGCCCTGAGGCCTTCATCCATATCATCAGCAACCCGGTCAAC | : 679 |
| LpMDHk29 | GAGGCTGTTGCAGACAACTGCCCTGAGGCCTTCATCCATATCATCAGCAACCCGGTCAAC | : 674 |
| LpMDHk30 | GAGGCTGTTGCAGACAACTGCCCTGAGGCCTTCATCCATATCATCAGCAACCCGGTCAAC | : 678 |
| LpMDHk31 | GAGGCTGNTGCAGACAACTGCCCTGAGGCCTTCATCCATATCATCAGCAACCCGGTCAAC | : 676 |
| LpMDHk32 | GAGGCTGTTGCAGACAACTGCC-------------------------------------- | : 637 |
| LpMDHk33 | GAGGCTGNTGCAGACAACTGCCCTGAGGCCTTCATCCATATCATCAGCAACCCGGTCAAC | : 675 |
| LpMDHk34 | GAGGCTGTTGCAGACAACTGCCCTGAGGCCTTCATCCATATCATCAGCAACCCGGTCAAC | : 675 |
| LpMDHk35 | GAGGCTGTTGCAGACAACTGCCCTGAGGCCTTCATCCATATCATCAGCAACCCGGTCAAC | : 674 |
| LpMDHk36 | GAGGCTGTTGCAGACAACTGCCCTGAGGCCTTCATCCATATCATCAGCAACCCGGTCAAC | : 674 |
| LpMDHk37 | GAGGCTGTTGCAGAC-ACT-GCCTGAGGCCTT-ATCCATAT-ATCA-NNACCCGG--GAC | : 659 |
| LpMDHk38 | GAGGCTGTTGCAGACAACTGCCCTGAGGNCTTGATCCATAT-ATGAGAACCCGGNCAAC | : 669 |
| LpMDHk39 | GAGGCTGNTGCAGACAACTGCCCTGAGGCCTT---------------------------- | : 644 |
| LpMDHk40 | GAGGCTGTTGCAGACAACTGCCCTGAGGCCTTCATCCATAT-ATCAGCAACCCGGTCAAC | : 669 |
| LpMDHk41 | GAGGCTGTTGCAGACAACTGCCCTGAGGCCTTCATCCATAT-ATCAGCAACCCGGTCAAC | : 670 |
| LpMDHk42 | GAGGCTGTTGCAGACAACTGCCCTGAGGCCTTCATCCATATCATCAGCAACCCGGTCAAC | : 666 |
| LpMDHk43 | CGGATTGCTGCTGAGATCTAAACAGAA--------------------------------- | : 637 |
| LpMDHk44 | GAGGCTGTTGCAGACAACTGCCCTGAGGCCTTCATCCATATCATCAGCAACCCGGTCAAC | : 671 |
| LpMDHk45 | GAGGCTGTTGCAGACAACTGCCCTGAGGCCTTCATCCATATCATCAGCAACCCGGTCAAC | : 670 |
| LpMDHk46 | GAGGCTGTTGCAGACAACTGCCCTGAGGCCTTCATCCAT--------------------- | : 647 |
| LpMDHk47 | GAGGCTGTTGCAGACAACTGCCCTGAGGCCTTCATCCATATCATCAGCAAC--------- | : 661 |
| LpMDHk48 | GAGGCTGTTGCAGACAACTGCCCTGAGGCTTCA--------------------------- | : 640 |
| LpMDHk49 | GAGGCTGTTGCAGACAACTGCCCTGAGGCCTTCATCCATAT-ATCAGCAACCCGGTCAAC | : 665 |
| LpMDHk50 | GAGGCTGTTGCAGACAACTGCCCTGAGGCCTTCATCCATAT-ATCAGCAACCCGGTCAAC | : 667 |
| LpMDHk51 | GAGGCTGNTGCAGACAACTGCCCTGAGGCCTTCATCCATAT-ATCAGCAACCCGGTCNA- | : 665 |
| LpMDHk52 | GAGGCTGTTGCAGACAACTGCCCTGAGGCCTTCATCCATAT-ATCAGCAACCCGGTCAAC | : 665 |
| LpMDHk53 | GAGGCTGTTGCAGACAACTGCCCTGAGGCCTTCATCCATAT-ATCAGCAACCCGGTCAAC | : 666 |
| LpMDHk54 | GAGGCTGTTGCAGACAACTGCCCTGAGGCCTTCATCCATAT-ATCAGCAACCCGGTCAAC | : 664 |
| LpMDHk55 | GAGGCTGTTGCAGACAACTGCCCTGAGGCCTTCATCCATAT-ATCAGCAACCCGGTCAAC | : 663 |
| LpMDHk56 | GAGGCTGTTGCAGACAACTGCCCTGAGGCCTTCATCCATAT-ATCAGCAACCCGGTCAAC | : 657 |
| LpMDHk57 | GAGGCTGNTGCAGACAACTGCCCTGAGGCCTTCATCCATAT-ATCAGCAACCCGGTCNAC | : 657 |
| LpMDHk58 | ------------------------------------------------------------ | : - |
| LpMDHk59 | AAGGCTGTTGCAGACAACTGCCTGAGGCCTTCATCCATATCATCAGCAACCCGGTCAAC | : 639 |
| LpMDHk60 | GAGGCTGTTGCAGACAACTGCCCTGAGGCCTTCATCCATATCATCAGCAACCCGGTCAAC | : 642 |
| LpMDHk61 | GAGGCTGTTGCAGACAACTGCCCTGAGGCCTTCATCCATATCATCAGCAACCCGGTCAAC | : 635 |
| LpMDHk62 | ------------------------------------------------------------ | : - |
| LpMDHk63 | GAGGCTGTTGCAGACAACTGCCCTGAGGCCTTCATCCATAT-ATCAGCAACCCGGTCAAC | : 629 |
| LpMDHk64 | GAGGCTGTTGCAGACAACTGCCCTGAGGCCTTCATCCATAT-ATCAGCAACCCGGTCAAC | : 615 |
| LpMDHk65 | GAGGCTGTTGCAGACAACTGCCCAGAGGCCTTCATCCATATCATCAGCAACCCGGTCAAC | : 347 |
| LpMDHk66 | GAGGCTGTTGCAGACAACTGCCCAGAGGCCTTCATCCATATCATCAGCAACCCGGTCAAC | : 234 |

FIGURE 7 (cont.)

```
                        *         740         *         760         *         780
LpMDHk1  : ------------------------------------------------------------- : -
LpMDHk2  : ------------------------------------------------------------- : -
LpMDHk3  : TCCACGGTGCCGATTGCTGCTGAGATTCTGAAACAGAAGGGCGTCTACAACCCCAAGAAG : 746
LpMDHk4  : TNCACTGT---------------------------------------------------- : 692
LpMDHk5  : TNCACTGTGA-------------------------------------------------- : 695
LpMDHk6  : ------------------------------------------------------------- : -
LpMDHk7  : ------------------------------------------------------------- : -
LpMDHk8  : ------------------------------------------------------------- : -
LpMDHk9  : TNCACTGTGCCGATTGCTGCTGA------------------------------------- : 706
LpMDHk10 : TCCACTGTGCCGATTGCTGCTGAA------------------------------------ : 706
LpMDHk11 : TCCACGGTGCCGATTGCTGCTGAGATTCTGAAACAGAAGGGCGTNTACAACCCCAAGAAG : 741
LpMDHk12 : TNCACTGTG--------------------------------------------------- : 691
LpMDHk13 : TNCACTGTGCCGATTGCTGCTGAG------------------------------------ : 705
LpMDHk14 : ------------------------------------------------------------- : -
LpMDHk15 : TCCACTGTGCCGATTGCTGCTGAGAT---------------------------------- : 705
LpMDHk16 : TNCACTGTGCCGATTGCTGCTGAGATA--------------------------------- : 706
LpMDHk17 : ------------------------------------------------------------- : -
LpMDHk18 : TCCACTGTGCCGATTGCTGCTGAGATTCTGAAACAGAAGGGCGTCTACAACCCCAAGAAG : 740
LpMDHk19 : TCCACTGNGCCGATTGCTGCTGANATTCTGAAACANAAGGGCGNNTACAACCCCAANAAG : 740
LpMDHk20 : TCCACTGTGCCGATTGCTGCTGAGATTCTGAAACAGAAGGGCGTCTACAACCCCAAGAAG : 740
LpMDHk21 : TCCACTGTGCCGATTGCTGCTGAGATTCTGAAACAGAAGGGCGTCTACAACCCCAAGAAG : 740
LpMDHk22 : TCCACTGTGCCGATTGCTGCTGAGATTCTGAAACAGAAGGGCGTCTACAACCCCAAGAAG : 740
LpMDHk23 : ------------------------------------------------------------- : -
LpMDHk24 : ------------------------------------------------------------- : -
LpMDHk25 : TCCACTGTGCCGATTGCTGCT--------------------------------------- : 698
LpMDHk26 : TNCACTGTGCCGATTGCTGCTGAGATTCTGAAAN-------------------------- : 713
LpMDHk27 : TCCACTGTGCCGATTGCTGCTGAGATTCTGAAACAGAAGGGCGTCTACAACCCCAAGAAG : 738
LpMDHk28 : TCCACTGTGCCGATTGCTGCTGAGATTCTGAAACAGAAGGGCGTCTACAACCCCAAGAAG : 739
LpMDHk29 : TTCACTGTGC-------------------------------------------------- : 684
LpMDHk30 : TNCACTGTGCCGATTGT------------------------------------------- : 695
LpMDHk31 : TNCACTGTGCCGATTGCTC----------------------------------------- : 695
LpMDHk32 : ------------------------------------------------------------- : -
LpMDHk33 : ------------------------------------------------------------- : -
LpMDHk34 : TCCACTGTGCCGATTGCTGCTGAGATTCTGAAACAGAANGGCGTNT-CCACCCCAAGAAG : 734
LpMDHk35 : TCCACGGTGCCGATTGCTGCTGAGATTCTGAAACAGAAGGGCGTCTACAACCCCAAGAAG : 734
LpMDHk36 : TNCACTGTGCCGATTGCTGCTGAGATTCTGAA---------------------------- : 706
LpMDHk37 : TGCACGGTGCCGATTGCTCNAN-------------------------------------- : 682
LpMDHk38 : TCCACGGCGCCGATTGNTGCAGAGATTCTGAAACAGAA-GGCGT---------------- : 712
LpMDHk39 : ------------------------------------------------------------- : -
LpMDHk40 : TNCACGGTGCCGAT---------------------------------------------- : 683
LpMDHk41 : TCCACGGTGCCGATTGCTGCAGAGA----------------------------------- : 695
LpMDHk42 : TCCACGGTGCCGATTGCTGCTGAGATTCTGAAACAGAAGGGCGTCTACAACCCCAAGAAG : 726
LpMDHk43 : ------------------------------------------------------------- : -
LpMDHk44 : TNCACTGTGCCGATT--------------------------------------------- : 686
LpMDHk45 : TNCACTGTGCCGATTGCTGCTGC------------------------------------- : 693
LpMDHk46 : ------------------------------------------------------------- : -
LpMDHk47 : ------------------------------------------------------------- : -
LpMDHk48 : ------------------------------------------------------------- : -
LpMDHk49 : TCCACGGTGCCGATTG-------------------------------------------- : 681
LpMDHk50 : TCCACGGTGCCGATTGCTGCAGAGATTCTGAAACAGAAGGGCGTCTACAACCCCAAGAAG : 727
LpMDHk51 : ------------------------------------------------------------- : -
LpMDHk52 : TNCACGGTGCCGATN--------------------------------------------- : 680
LpMDHk53 : TCCACGGTGCCGATTGCTGCAGAGATTCTGAAACAGAAGGGCGTCTACAACCCCAAGAAG : 726
LpMDHk54 : TCCACGGTGCCGATTGCTGCAGAGATTCTGAAACAGAC---------------------- : 702
LpMDHk55 : TCCACGGTGCCGATTGCTGCAGAGATTCTGAAACAGAAGGGCGTCTACAACCCCAAGAAG : 723
LpMDHk56 : TNCACGGTGCCGATTGCTGCAGAGATTCTGAAACA-AANGGCGTCTACAAC--------- : 707
LpMDHk57 : TCCACGGNGCCGATTGNTGCNANATTNTGN------------------------------ : 687
LpMDHk58 : ------------------------------------------------------------- : -
LpMDHk59 : TNC---------------------------------------------------------- : 642
LpMDHk60 : TCCACTGTGCCGATTGCTGCTGAGATTCTGAAACAGAAGGGCGTCTACAACCCCAAGAAG : 702
LpMDHk61 : TNCACTGTGCCGATTGCTGCTGAGATTCTGAAACAGAAGGGCGTCTACACCCCCAAGAAG : 695
LpMDHk62 : ------------------------------------------------------------- : -
LpMDHk63 : T----------------------------------------------------------- : 630
LpMDHk64 : TNCACGGTGCCGATTGCTGCAGAGATTCTGAAACAGAAGGGCGTCTACAACCCCAA---- : 671
LpMDHk65 : TCCACTGTGCCGATTGCTGCTGAGATTCTGAAACAGAAGGGGTCTACAACCCCAAGAAG  : 407
LpMDHk66 : TCCACTGTGCCGATTGCTGCTGAGATTCTGAAACAGAAGGGGTCTACAACCCCAAGAAG  : 294
```

FIGURE 7 (cont.)

|          |   | * | 800 | * | 820 | * | 840 |   |     |
|----------|---|---|-----|---|-----|---|-----|---|-----|
| LpMDHk1  | : | ---------------------------------------------------------------- | : | -   |
| LpMDHk2  | : | ---------------------------------------------------------------- | : | -   |
| LpMDHk3  | : | CTCTTCGGGGTTTNCACCCTGGATGTTGTCAGAGCTAACACATTTGTAGCTCANA----- | : | 801 |
| LpMDHk4  | : | ---------------------------------------------------------------- | : | -   |
| LpMDHk5  | : | ---------------------------------------------------------------- | : | -   |
| LpMDHk6  | : | ---------------------------------------------------------------- | : | -   |
| LpMDHk7  | : | ---------------------------------------------------------------- | : | -   |
| LpMDHk8  | : | ---------------------------------------------------------------- | : | -   |
| LpMDHk9  | : | ---------------------------------------------------------------- | : | -   |
| LpMDHk10 | : | ---------------------------------------------------------------- | : | -   |
| LpMDHk11 | : | CTCTTCGGGGTTTCCACCCTGGATGTTGTCAGAGCTAACACATTTGTAGCTCAAANAAN | : | 801 |
| LpMDHk12 | : | ---------------------------------------------------------------- | : | -   |
| LpMDHk13 | : | ---------------------------------------------------------------- | : | -   |
| LpMDHk14 | : | ---------------------------------------------------------------- | : | -   |
| LpMDHk15 | : | ---------------------------------------------------------------- | : | -   |
| LpMDHk16 | : | ---------------------------------------------------------------- | : | -   |
| LpMDHk17 | : | ---------------------------------------------------------------- | : | -   |
| LpMDHk18 | : | CTCTTCGGGGTTTCCACC----------------------------------------------- | : | 758 |
| LpMDHk19 | : | CTCTTNGGGGNTTNCACCCTG-------------------------------------------- | : | 761 |
| LpMDHk20 | : | CTCTTCGGGGTTTCCACCCTGGATGTTGTCAN-------------------------------- | : | 772 |
| LpMDHk21 | : | CTCTTCGGGGTTTCCACCCTGGATGTTGTCAN-------------------------------- | : | 772 |
| LpMDHk22 | : | CTCTTCGGGGTTTCCACCCTGGATGTTGTCAGAGCTAACACATTTGTAGCTCANAAGAAG | : | 800 |
| LpMDHk23 | : | ---------------------------------------------------------------- | : | -   |
| LpMDHk24 | : | ---------------------------------------------------------------- | : | -   |
| LpMDHk25 | : | ---------------------------------------------------------------- | : | -   |
| LpMDHk26 | : | ---------------------------------------------------------------- | : | -   |
| LpMDHk27 | : | CTCTTCGGGGTTTCCACCCTGGATGTTGTCAGA------------------------------- | : | 771 |
| LpMDHk28 | : | CTCTTCGGGGTTTCCACCCTGGATGTTGTCAGAG------------------------------ | : | 773 |
| LpMDHk29 | : | ---------------------------------------------------------------- | : | -   |
| LpMDHk30 | : | ---------------------------------------------------------------- | : | -   |
| LpMDHk31 | : | ---------------------------------------------------------------- | : | -   |
| LpMDHk32 | : | ---------------------------------------------------------------- | : | -   |
| LpMDHk33 | : | ---------------------------------------------------------------- | : | -   |
| LpMDHk34 | : | CTNTTCNGGGNTTACACCCTGGATGTTGCC---------------------------------- | : | 764 |
| LpMDHk35 | : | CTCTTCGGGGNTTCCACCCTGGATGTTGTCAGAGCTAACACATTTGTAGCT-------- | : | 785 |
| LpMDHk36 | : | ---------------------------------------------------------------- | : | -   |
| LpMDHk37 | : | ---------------------------------------------------------------- | : | -   |
| LpMDHk38 | : | ---------------------------------------------------------------- | : | -   |
| LpMDHk39 | : | ---------------------------------------------------------------- | : | -   |
| LpMDHk40 | : | ---------------------------------------------------------------- | : | -   |
| LpMDHk41 | : | ---------------------------------------------------------------- | : | -   |
| LpMDHk42 | : | CTCTTCGGGGTTTNCACCCTGGATGTTGTCAGAGCTAACACATTTGNAGCTCANAANAAG | : | 786 |
| LpMDHk43 | : | ---------------------------------------------------------------- | : | -   |
| LpMDHk44 | : | ---------------------------------------------------------------- | : | -   |
| LpMDHk45 | : | ---------------------------------------------------------------- | : | -   |
| LpMDHk46 | : | ---------------------------------------------------------------- | : | -   |
| LpMDHk47 | : | ---------------------------------------------------------------- | : | -   |
| LpMDHk48 | : | ---------------------------------------------------------------- | : | -   |
| LpMDHk49 | : | ---------------------------------------------------------------- | : | -   |
| LpMDHk50 | : | CTCTTCGGGGTTTC-------------------------------------------------- | : | 741 |
| LpMDHk51 | : | ---------------------------------------------------------------- | : | -   |
| LpMDHk52 | : | ---------------------------------------------------------------- | : | -   |
| LpMDHk53 | : | CTCTTCGGGGTTTCCACCCTGGATGTTGTCAGGCTAACACATT-------------------- | : | 770 |
| LpMDHk54 | : | ---------------------------------------------------------------- | : | -   |
| LpMDHk55 | : | CTCTTCGGGGTTTCCCCCCTGGATGTTGTCAGGCTAACACATTTGTAGCTCA------ | : | 777 |
| LpMDHk56 | : | ---------------------------------------------------------------- | : | -   |
| LpMDHk57 | : | ---------------------------------------------------------------- | : | -   |
| LpMDHk58 | : | ---------------------------------------------------------------- | : | -   |
| LpMDHk59 | : | ---------------------------------------------------------------- | : | -   |
| LpMDHk60 | : | CTCTTCGGGGTTTCCACCCTGGATGTTGTCAGAGCTAACACATTTGTAGCTCAGAAGAAG | : | 762 |
| LpMDHk61 | : | CTCTTN---------------------------------------------------------- | : | 701 |
| LpMDHk62 | : | ---------------------------------------------------------------- | : | -   |
| LpMDHk63 | : | ---------------------------------------------------------------- | : | -   |
| LpMDHk64 | : | ---------------------------------------------------------------- | : | -   |
| LpMDHk65 | : | CTCTTCGGGGTTTCCACCCTGGATGTTGTCAGAGCTAACACATTTGTAGCTCAGAAGAAG | : | 467 |
| LpMDHk66 | : | CTCTTCGGGGTTTCCACCCTGGATGTTGTCAGAGCTAACACATTTGTAGCTCAGAAGAAG | : | 354 |

FIGURE 7 (cont.)

```
              *         860         *         880         *         900
LpMDHk1  : ------------------------------------------------------------ :   -
LpMDHk2  : ------------------------------------------------------------ :   -
LpMDHk3  : ------------------------------------------------------------ :   -
LpMDHk4  : ------------------------------------------------------------ :   -
LpMDHk5  : ------------------------------------------------------------ :   -
LpMDHk6  : ------------------------------------------------------------ :   -
LpMDHk7  : ------------------------------------------------------------ :   -
LpMDHk8  : ------------------------------------------------------------ :   -
LpMDHk9  : ------------------------------------------------------------ :   -
LpMDHk10 : ------------------------------------------------------------ :   -
LpMDHk11 : A----------------------------------------------------------- : 802
LpMDHk12 : ------------------------------------------------------------ :   -
LpMDHk13 : ------------------------------------------------------------ :   -
LpMDHk14 : ------------------------------------------------------------ :   -
LpMDHk15 : ------------------------------------------------------------ :   -
LpMDHk16 : ------------------------------------------------------------ :   -
LpMDHk17 : ------------------------------------------------------------ :   -
LpMDHk18 : ------------------------------------------------------------ :   -
LpMDHk19 : ------------------------------------------------------------ :   -
LpMDHk20 : ------------------------------------------------------------ :   -
LpMDHk21 : ------------------------------------------------------------ :   -
LpMDHk22 : AACCTCA----------------------------------------------------- : 807
LpMDHk23 : ------------------------------------------------------------ :   -
LpMDHk24 : ------------------------------------------------------------ :   -
LpMDHk25 : ------------------------------------------------------------ :   -
LpMDHk26 : ------------------------------------------------------------ :   -
LpMDHk27 : ------------------------------------------------------------ :   -
LpMDHk28 : ------------------------------------------------------------ :   -
LpMDHk29 : ------------------------------------------------------------ :   -
LpMDHk30 : ------------------------------------------------------------ :   -
LpMDHk31 : ------------------------------------------------------------ :   -
LpMDHk32 : ------------------------------------------------------------ :   -
LpMDHk33 : ------------------------------------------------------------ :   -
LpMDHk34 : ------------------------------------------------------------ :   -
LpMDHk35 : ------------------------------------------------------------ :   -
LpMDHk36 : ------------------------------------------------------------ :   -
LpMDHk37 : ------------------------------------------------------------ :   -
LpMDHk38 : ------------------------------------------------------------ :   -
LpMDHk39 : ------------------------------------------------------------ :   -
LpMDHk40 : ------------------------------------------------------------ :   -
LpMDHk41 : ------------------------------------------------------------ :   -
LpMDHk42 : AACCTCAGCCTCATCG-------------------------------------------- : 802
LpMDHk43 : ------------------------------------------------------------ :   -
LpMDHk44 : ------------------------------------------------------------ :   -
LpMDHk45 : ------------------------------------------------------------ :   -
LpMDHk46 : ------------------------------------------------------------ :   -
LpMDHk47 : ------------------------------------------------------------ :   -
LpMDHk48 : ------------------------------------------------------------ :   -
LpMDHk49 : ------------------------------------------------------------ :   -
LpMDHk50 : ------------------------------------------------------------ :   -
LpMDHk51 : ------------------------------------------------------------ :   -
LpMDHk52 : ------------------------------------------------------------ :   -
LpMDHk53 : ------------------------------------------------------------ :   -
LpMDHk54 : ------------------------------------------------------------ :   -
LpMDHk55 : ------------------------------------------------------------ :   -
LpMDHk56 : ------------------------------------------------------------ :   -
LpMDHk57 : ------------------------------------------------------------ :   -
LpMDHk58 : ------------------------------------------------------------ :   -
LpMDHk59 : ------------------------------------------------------------ :   -
LpMDHk60 : AACCT------------------------------------------------------- : 767
LpMDHk61 : ------------------------------------------------------------ :   -
LpMDHk62 : ------------------------------------------------------------ :   -
LpMDHk63 : ------------------------------------------------------------ :   -
LpMDHk64 : ------------------------------------------------------------ :   -
LpMDHk65 : AACCTCAGCCTCATCGATGTTGATGTCCCAGTTGTCGGTGGCCATGCTGGGATCACGATT : 527
LpMDHk66 : AACCTCAGCCTCATCGATGTTGATGTCCCAGTTGTCGGTGGCCATGCTGGGATCACGATT : 414
```

FIGURE 7 (cont.)

```
                            *        920         *        940         *        960
LpMDHk1  : ------------------------------------------------------------ :   -
LpMDHk2  : ------------------------------------------------------------ :   -
LpMDHk3  : ------------------------------------------------------------ :   -
LpMDHk4  : ------------------------------------------------------------ :   -
LpMDHk5  : ------------------------------------------------------------ :   -
LpMDHk6  : ------------------------------------------------------------ :   -
LpMDHk7  : ------------------------------------------------------------ :   -
LpMDHk8  : ------------------------------------------------------------ :   -
LpMDHk9  : ------------------------------------------------------------ :   -
LpMDHk10 : ------------------------------------------------------------ :   -
LpMDHk11 : ------------------------------------------------------------ :   -
LpMDHk12 : ------------------------------------------------------------ :   -
LpMDHk13 : ------------------------------------------------------------ :   -
LpMDHk14 : ------------------------------------------------------------ :   -
LpMDHk15 : ------------------------------------------------------------ :   -
LpMDHk16 : ------------------------------------------------------------ :   -
LpMDHk17 : ------------------------------------------------------------ :   -
LpMDHk18 : ------------------------------------------------------------ :   -
LpMDHk19 : ------------------------------------------------------------ :   -
LpMDHk20 : ------------------------------------------------------------ :   -
LpMDHk21 : ------------------------------------------------------------ :   -
LpMDHk22 : ------------------------------------------------------------ :   -
LpMDHk23 : ------------------------------------------------------------ :   -
LpMDHk24 : ------------------------------------------------------------ :   -
LpMDHk25 : ------------------------------------------------------------ :   -
LpMDHk26 : ------------------------------------------------------------ :   -
LpMDHk27 : ------------------------------------------------------------ :   -
LpMDHk28 : ------------------------------------------------------------ :   -
LpMDHk29 : ------------------------------------------------------------ :   -
LpMDHk30 : ------------------------------------------------------------ :   -
LpMDHk31 : ------------------------------------------------------------ :   -
LpMDHk32 : ------------------------------------------------------------ :   -
LpMDHk33 : ------------------------------------------------------------ :   -
LpMDHk34 : ------------------------------------------------------------ :   -
LpMDHk35 : ------------------------------------------------------------ :   -
LpMDHk36 : ------------------------------------------------------------ :   -
LpMDHk37 : ------------------------------------------------------------ :   -
LpMDHk38 : ------------------------------------------------------------ :   -
LpMDHk39 : ------------------------------------------------------------ :   -
LpMDHk40 : ------------------------------------------------------------ :   -
LpMDHk41 : ------------------------------------------------------------ :   -
LpMDHk42 : ------------------------------------------------------------ :   -
LpMDHk43 : ------------------------------------------------------------ :   -
LpMDHk44 : ------------------------------------------------------------ :   -
LpMDHk45 : ------------------------------------------------------------ :   -
LpMDHk46 : ------------------------------------------------------------ :   -
LpMDHk47 : ------------------------------------------------------------ :   -
LpMDHk48 : ------------------------------------------------------------ :   -
LpMDHk49 : ------------------------------------------------------------ :   -
LpMDHk50 : ------------------------------------------------------------ :   -
LpMDHk51 : ------------------------------------------------------------ :   -
LpMDHk52 : ------------------------------------------------------------ :   -
LpMDHk53 : ------------------------------------------------------------ :   -
LpMDHk54 : ------------------------------------------------------------ :   -
LpMDHk55 : ------------------------------------------------------------ :   -
LpMDHk56 : ------------------------------------------------------------ :   -
LpMDHk57 : ------------------------------------------------------------ :   -
LpMDHk58 : ------------------------------------------------------------ :   -
LpMDHk59 : ------------------------------------------------------------ :   -
LpMDHk60 : ------------------------------------------------------------ :   -
LpMDHk61 : ------------------------------------------------------------ :   -
LpMDHk62 : ------------------------------------------------------------ :   -
LpMDHk63 : ------------------------------------------------------------ :   -
LpMDHk64 : ------------------------------------------------------------ :   -
LpMDHk65 : CTGCCTCTGTTGTCCAAGACTAGGCCTTCTGTCAGCTTCACGGACGAGGAAACTGAACAG : 587
LpMDHk66 : CTGCCTCTGTTGTCCAAGACTAGGCCTTCTGTCAGCTTCACGGACGAGGAAACTGAACAG : 474
```

FIGURE 7 (cont.)

```
                    *         980         *        1000         *        1020
LpMDHk1   : ----------------------------------------------------------------- : -
LpMDHk2   : ----------------------------------------------------------------- : -
LpMDHk3   : ----------------------------------------------------------------- : -
LpMDHk4   : ----------------------------------------------------------------- : -
LpMDHk5   : ----------------------------------------------------------------- : -
LpMDHk6   : ----------------------------------------------------------------- : -
LpMDHk7   : ----------------------------------------------------------------- : -
LpMDHk8   : ----------------------------------------------------------------- : -
LpMDHk9   : ----------------------------------------------------------------- : -
LpMDHk10  : ----------------------------------------------------------------- : -
LpMDHk11  : ----------------------------------------------------------------- : -
LpMDHk12  : ----------------------------------------------------------------- : -
LpMDHk13  : ----------------------------------------------------------------- : -
LpMDHk14  : ----------------------------------------------------------------- : -
LpMDHk15  : ----------------------------------------------------------------- : -
LpMDHk16  : ----------------------------------------------------------------- : -
LpMDHk17  : ----------------------------------------------------------------- : -
LpMDHk18  : ----------------------------------------------------------------- : -
LpMDHk19  : ----------------------------------------------------------------- : -
LpMDHk20  : ----------------------------------------------------------------- : -
LpMDHk21  : ----------------------------------------------------------------- : -
LpMDHk22  : ----------------------------------------------------------------- : -
LpMDHk23  : ----------------------------------------------------------------- : -
LpMDHk24  : ----------------------------------------------------------------- : -
LpMDHk25  : ----------------------------------------------------------------- : -
LpMDHk26  : ----------------------------------------------------------------- : -
LpMDHk27  : ----------------------------------------------------------------- : -
LpMDHk28  : ----------------------------------------------------------------- : -
LpMDHk29  : ----------------------------------------------------------------- : -
LpMDHk30  : ----------------------------------------------------------------- : -
LpMDHk31  : ----------------------------------------------------------------- : -
LpMDHk32  : ----------------------------------------------------------------- : -
LpMDHk33  : ----------------------------------------------------------------- : -
LpMDHk34  : ----------------------------------------------------------------- : -
LpMDHk35  : ----------------------------------------------------------------- : -
LpMDHk36  : ----------------------------------------------------------------- : -
LpMDHk37  : ----------------------------------------------------------------- : -
LpMDHk38  : ----------------------------------------------------------------- : -
LpMDHk39  : ----------------------------------------------------------------- : -
LpMDHk40  : ----------------------------------------------------------------- : -
LpMDHk41  : ----------------------------------------------------------------- : -
LpMDHk42  : ----------------------------------------------------------------- : -
LpMDHk43  : ----------------------------------------------------------------- : -
LpMDHk44  : ----------------------------------------------------------------- : -
LpMDHk45  : ----------------------------------------------------------------- : -
LpMDHk46  : ----------------------------------------------------------------- : -
LpMDHk47  : ----------------------------------------------------------------- : -
LpMDHk48  : ----------------------------------------------------------------- : -
LpMDHk49  : ----------------------------------------------------------------- : -
LpMDHk50  : ----------------------------------------------------------------- : -
LpMDHk51  : ----------------------------------------------------------------- : -
LpMDHk52  : ----------------------------------------------------------------- : -
LpMDHk53  : ----------------------------------------------------------------- : -
LpMDHk54  : ----------------------------------------------------------------- : -
LpMDHk55  : ----------------------------------------------------------------- : -
LpMDHk56  : ----------------------------------------------------------------- : -
LpMDHk57  : ----------------------------------------------------------------- : -
LpMDHk58  : ----------------------------------------------------------------- : -
LpMDHk59  : ----------------------------------------------------------------- : -
LpMDHk60  : ----------------------------------------------------------------- : -
LpMDHk61  : ----------------------------------------------------------------- : -
LpMDHk62  : ----------------------------------------------------------------- : -
LpMDHk63  : ----------------------------------------------------------------- : -
LpMDHk64  : ----------------------------------------------------------------- : -
LpMDHk65  : CTGACAAAGAGGATACAGAACGCTGGGACAGAGGTGGTGGAGGCGAA--------------- : 634
LpMDHk66  : CTGACAAAGAGGATACAGAACGCTGGGACAGAGGCGGTGGAGGCGAAGGCTGGTGCTGGC   : 534
```

FIGURE 7 (cont.)

|         |   | *   1040   *   1060   *   1080                                                      |     |
|---------|---|--------------------------------------------------------------------------------------|-----|
| LpMDHk1 | : | ------------------------------------------------------------                         | -   |
| LpMDHk2 | : | ------------------------------------------------------------                         | -   |
| LpMDHk3 | : | ------------------------------------------------------------                         | -   |
| LpMDHk4 | : | ------------------------------------------------------------                         | -   |
| LpMDHk5 | : | ------------------------------------------------------------                         | -   |
| LpMDHk6 | : | ------------------------------------------------------------                         | -   |
| LpMDHk7 | : | ------------------------------------------------------------                         | -   |
| LpMDHk8 | : | ------------------------------------------------------------                         | -   |
| LpMDHk9 | : | ------------------------------------------------------------                         | -   |
| LpMDHk10 | : | ------------------------------------------------------------                        | -   |
| LpMDHk11 | : | ------------------------------------------------------------                        | -   |
| LpMDHk12 | : | ------------------------------------------------------------                        | -   |
| LpMDHk13 | : | ------------------------------------------------------------                        | -   |
| LpMDHk14 | : | ------------------------------------------------------------                        | -   |
| LpMDHk15 | : | ------------------------------------------------------------                        | -   |
| LpMDHk16 | : | ------------------------------------------------------------                        | -   |
| LpMDHk17 | : | ------------------------------------------------------------                        | -   |
| LpMDHk18 | : | ------------------------------------------------------------                        | -   |
| LpMDHk19 | : | ------------------------------------------------------------                        | -   |
| LpMDHk20 | : | ------------------------------------------------------------                        | -   |
| LpMDHk21 | : | ------------------------------------------------------------                        | -   |
| LpMDHk22 | : | ------------------------------------------------------------                        | -   |
| LpMDHk23 | : | ------------------------------------------------------------                        | -   |
| LpMDHk24 | : | ------------------------------------------------------------                        | -   |
| LpMDHk25 | : | ------------------------------------------------------------                        | -   |
| LpMDHk26 | : | ------------------------------------------------------------                        | -   |
| LpMDHk27 | : | ------------------------------------------------------------                        | -   |
| LpMDHk28 | : | ------------------------------------------------------------                        | -   |
| LpMDHk29 | : | ------------------------------------------------------------                        | -   |
| LpMDHk30 | : | ------------------------------------------------------------                        | -   |
| LpMDHk31 | : | ------------------------------------------------------------                        | -   |
| LpMDHk32 | : | ------------------------------------------------------------                        | -   |
| LpMDHk33 | : | ------------------------------------------------------------                        | -   |
| LpMDHk34 | : | ------------------------------------------------------------                        | -   |
| LpMDHk35 | : | ------------------------------------------------------------                        | -   |
| LpMDHk36 | : | ------------------------------------------------------------                        | -   |
| LpMDHk37 | : | ------------------------------------------------------------                        | -   |
| LpMDHk38 | : | ------------------------------------------------------------                        | -   |
| LpMDHk39 | : | ------------------------------------------------------------                        | -   |
| LpMDHk40 | : | ------------------------------------------------------------                        | -   |
| LpMDHk41 | : | ------------------------------------------------------------                        | -   |
| LpMDHk42 | : | ------------------------------------------------------------                        | -   |
| LpMDHk43 | : | ------------------------------------------------------------                        | -   |
| LpMDHk44 | : | ------------------------------------------------------------                        | -   |
| LpMDHk45 | : | ------------------------------------------------------------                        | -   |
| LpMDHk46 | : | ------------------------------------------------------------                        | -   |
| LpMDHk47 | : | ------------------------------------------------------------                        | -   |
| LpMDHk48 | : | ------------------------------------------------------------                        | -   |
| LpMDHk49 | : | ------------------------------------------------------------                        | -   |
| LpMDHk50 | : | ------------------------------------------------------------                        | -   |
| LpMDHk51 | : | ------------------------------------------------------------                        | -   |
| LpMDHk52 | : | ------------------------------------------------------------                        | -   |
| LpMDHk53 | : | ------------------------------------------------------------                        | -   |
| LpMDHk54 | : | ------------------------------------------------------------                        | -   |
| LpMDHk55 | : | ------------------------------------------------------------                        | -   |
| LpMDHk56 | : | ------------------------------------------------------------                        | -   |
| LpMDHk57 | : | ------------------------------------------------------------                        | -   |
| LpMDHk58 | : | ------------------------------------------------------------                        | -   |
| LpMDHk59 | : | ------------------------------------------------------------                        | -   |
| LpMDHk60 | : | ------------------------------------------------------------                        | -   |
| LpMDHk61 | : | ------------------------------------------------------------                        | -   |
| LpMDHk62 | : | ------------------------------------------------------------                        | -   |
| LpMDHk63 | : | ------------------------------------------------------------                        | -   |
| LpMDHk64 | : | ------------------------------------------------------------                        | -   |
| LpMDHk65 | : | ------------------------------------------------------------                        | -   |
| LpMDHk66 | : | TCTGCTACTCTGTCCATCGGCTTATGCCGCTGCCAGATTTGTTGAGTCATCGCTCCGCGCA                        | 594 |

FIGURE 7 (cont.)

|          | * | 1100 | * | 1120 | * | 1140 |   |     |
|----------|---|------|---|------|---|------|---|-----|
| LpMDHk1  | : | ------------------------------------------------- | : | -   |
| LpMDHk2  | : | ------------------------------------------------- | : | -   |
| LpMDHk3  | : | ------------------------------------------------- | : | -   |
| LpMDHk4  | : | ------------------------------------------------- | : | -   |
| LpMDHk5  | : | ------------------------------------------------- | : | -   |
| LpMDHk6  | : | ------------------------------------------------- | : | -   |
| LpMDHk7  | : | ------------------------------------------------- | : | -   |
| LpMDHk8  | : | ------------------------------------------------- | : | -   |
| LpMDHk9  | : | ------------------------------------------------- | : | -   |
| LpMDHk10 | : | ------------------------------------------------- | : | -   |
| LpMDHk11 | : | ------------------------------------------------- | : | -   |
| LpMDHk12 | : | ------------------------------------------------- | : | -   |
| LpMDHk13 | : | ------------------------------------------------- | : | -   |
| LpMDHk14 | : | ------------------------------------------------- | : | -   |
| LpMDHk15 | : | ------------------------------------------------- | : | -   |
| LpMDHk16 | : | ------------------------------------------------- | : | -   |
| LpMDHk17 | : | ------------------------------------------------- | : | -   |
| LpMDHk18 | : | ------------------------------------------------- | : | -   |
| LpMDHk19 | : | ------------------------------------------------- | : | -   |
| LpMDHk20 | : | ------------------------------------------------- | : | -   |
| LpMDHk21 | : | ------------------------------------------------- | : | -   |
| LpMDHk22 | : | ------------------------------------------------- | : | -   |
| LpMDHk23 | : | ------------------------------------------------- | : | -   |
| LpMDHk24 | : | ------------------------------------------------- | : | -   |
| LpMDHk25 | : | ------------------------------------------------- | : | -   |
| LpMDHk26 | : | ------------------------------------------------- | : | -   |
| LpMDHk27 | : | ------------------------------------------------- | : | -   |
| LpMDHk28 | : | ------------------------------------------------- | : | -   |
| LpMDHk29 | : | ------------------------------------------------- | : | -   |
| LpMDHk30 | : | ------------------------------------------------- | : | -   |
| LpMDHk31 | : | ------------------------------------------------- | : | -   |
| LpMDHk32 | : | ------------------------------------------------- | : | -   |
| LpMDHk33 | : | ------------------------------------------------- | : | -   |
| LpMDHk34 | : | ------------------------------------------------- | : | -   |
| LpMDHk35 | : | ------------------------------------------------- | : | -   |
| LpMDHk36 | : | ------------------------------------------------- | : | -   |
| LpMDHk37 | : | ------------------------------------------------- | : | -   |
| LpMDHk38 | : | ------------------------------------------------- | : | -   |
| LpMDHk39 | : | ------------------------------------------------- | : | -   |
| LpMDHk40 | : | ------------------------------------------------- | : | -   |
| LpMDHk41 | : | ------------------------------------------------- | : | -   |
| LpMDHk42 | : | ------------------------------------------------- | : | -   |
| LpMDHk43 | : | ------------------------------------------------- | : | -   |
| LpMDHk44 | : | ------------------------------------------------- | : | -   |
| LpMDHk45 | : | ------------------------------------------------- | : | -   |
| LpMDHk46 | : | ------------------------------------------------- | : | -   |
| LpMDHk47 | : | ------------------------------------------------- | : | -   |
| LpMDHk48 | : | ------------------------------------------------- | : | -   |
| LpMDHk49 | : | ------------------------------------------------- | : | -   |
| LpMDHk50 | : | ------------------------------------------------- | : | -   |
| LpMDHk51 | : | ------------------------------------------------- | : | -   |
| LpMDHk52 | : | ------------------------------------------------- | : | -   |
| LpMDHk53 | : | ------------------------------------------------- | : | -   |
| LpMDHk54 | : | ------------------------------------------------- | : | -   |
| LpMDHk55 | : | ------------------------------------------------- | : | -   |
| LpMDHk56 | : | ------------------------------------------------- | : | -   |
| LpMDHk57 | : | ------------------------------------------------- | : | -   |
| LpMDHk58 | : | ------------------------------------------------- | : | -   |
| LpMDHk59 | : | ------------------------------------------------- | : | -   |
| LpMDHk60 | : | ------------------------------------------------- | : | -   |
| LpMDHk61 | : | ------------------------------------------------- | : | -   |
| LpMDHk62 | : | ------------------------------------------------- | : | -   |
| LpMDHk63 | : | ------------------------------------------------- | : | -   |
| LpMDHk64 | : | ------------------------------------------------- | : | -   |
| LpMDHk65 | : | ------------------------------------------------- | : | -   |
| LpMDHk66 | : | ATGGCTGGTGATCCAGATGTTTACGAGTGCACGTATGTTCAGTCTGACTTAACAGAGCTT | : | 654 |

FIGURE 7 (cont.)

```
                  *        1160         *        1180         *        1200
LpMDHk1  : ------------------------------------------------------------ : -
LpMDHk2  : ------------------------------------------------------------ : -
LpMDHk3  : ------------------------------------------------------------ : -
LpMDHk4  : ------------------------------------------------------------ : -
LpMDHk5  : ------------------------------------------------------------ : -
LpMDHk6  : ------------------------------------------------------------ : -
LpMDHk7  : ------------------------------------------------------------ : -
LpMDHk8  : ------------------------------------------------------------ : -
LpMDHk9  : ------------------------------------------------------------ : -
LpMDHk10 : ------------------------------------------------------------ : -
LpMDHk11 : ------------------------------------------------------------ : -
LpMDHk12 : ------------------------------------------------------------ : -
LpMDHk13 : ------------------------------------------------------------ : -
LpMDHk14 : ------------------------------------------------------------ : -
LpMDHk15 : ------------------------------------------------------------ : -
LpMDHk16 : ------------------------------------------------------------ : -
LpMDHk17 : ------------------------------------------------------------ : -
LpMDHk18 : ------------------------------------------------------------ : -
LpMDHk19 : ------------------------------------------------------------ : -
LpMDHk20 : ------------------------------------------------------------ : -
LpMDHk21 : ------------------------------------------------------------ : -
LpMDHk22 : ------------------------------------------------------------ : -
LpMDHk23 : ------------------------------------------------------------ : -
LpMDHk24 : ------------------------------------------------------------ : -
LpMDHk25 : ------------------------------------------------------------ : -
LpMDHk26 : ------------------------------------------------------------ : -
LpMDHk27 : ------------------------------------------------------------ : -
LpMDHk28 : ------------------------------------------------------------ : -
LpMDHk29 : ------------------------------------------------------------ : -
LpMDHk30 : ------------------------------------------------------------ : -
LpMDHk31 : ------------------------------------------------------------ : -
LpMDHk32 : ------------------------------------------------------------ : -
LpMDHk33 : ------------------------------------------------------------ : -
LpMDHk34 : ------------------------------------------------------------ : -
LpMDHk35 : ------------------------------------------------------------ : -
LpMDHk36 : ------------------------------------------------------------ : -
LpMDHk37 : ------------------------------------------------------------ : -
LpMDHk38 : ------------------------------------------------------------ : -
LpMDHk39 : ------------------------------------------------------------ : -
LpMDHk40 : ------------------------------------------------------------ : -
LpMDHk41 : ------------------------------------------------------------ : -
LpMDHk42 : ------------------------------------------------------------ : -
LpMDHk43 : ------------------------------------------------------------ : -
LpMDHk44 : ------------------------------------------------------------ : -
LpMDHk45 : ------------------------------------------------------------ : -
LpMDHk46 : ------------------------------------------------------------ : -
LpMDHk47 : ------------------------------------------------------------ : -
LpMDHk48 : ------------------------------------------------------------ : -
LpMDHk49 : ------------------------------------------------------------ : -
LpMDHk50 : ------------------------------------------------------------ : -
LpMDHk51 : ------------------------------------------------------------ : -
LpMDHk52 : ------------------------------------------------------------ : -
LpMDHk53 : ------------------------------------------------------------ : -
LpMDHk54 : ------------------------------------------------------------ : -
LpMDHk55 : ------------------------------------------------------------ : -
LpMDHk56 : ------------------------------------------------------------ : -
LpMDHk57 : ------------------------------------------------------------ : -
LpMDHk58 : ------------------------------------------------------------ : -
LpMDHk59 : ------------------------------------------------------------ : -
LpMDHk60 : ------------------------------------------------------------ : -
LpMDHk61 : ------------------------------------------------------------ : -
LpMDHk62 : ------------------------------------------------------------ : -
LpMDHk63 : ------------------------------------------------------------ : -
LpMDHk64 : ------------------------------------------------------------ : -
LpMDHk65 : ------------------------------------------------------------ : -
LpMDHk66 : CCATTCTTCGCGTCCAGAGTTAAGCTTGGGAAGGACGGNGTTGAGTCCATCATTTCCTCC : 714
```

FIGURE 7 (cont.)

```
                      *         1220         *         1240         *         1260
LpMDHk1   : ------------------------------------------------------------ :   -
LpMDHk2   : ------------------------------------------------------------ :   -
LpMDHk3   : ------------------------------------------------------------ :   -
LpMDHk4   : ------------------------------------------------------------ :   -
LpMDHk5   : ------------------------------------------------------------ :   -
LpMDHk6   : ------------------------------------------------------------ :   -
LpMDHk7   : ------------------------------------------------------------ :   -
LpMDHk8   : ------------------------------------------------------------ :   -
LpMDHk9   : ------------------------------------------------------------ :   -
LpMDHk10  : ------------------------------------------------------------ :   -
LpMDHk11  : ------------------------------------------------------------ :   -
LpMDHk12  : ------------------------------------------------------------ :   -
LpMDHk13  : ------------------------------------------------------------ :   -
LpMDHk14  : ------------------------------------------------------------ :   -
LpMDHk15  : ------------------------------------------------------------ :   -
LpMDHk16  : ------------------------------------------------------------ :   -
LpMDHk17  : ------------------------------------------------------------ :   -
LpMDHk18  : ------------------------------------------------------------ :   -
LpMDHk19  : ------------------------------------------------------------ :   -
LpMDHk20  : ------------------------------------------------------------ :   -
LpMDHk21  : ------------------------------------------------------------ :   -
LpMDHk22  : ------------------------------------------------------------ :   -
LpMDHk23  : ------------------------------------------------------------ :   -
LpMDHk24  : ------------------------------------------------------------ :   -
LpMDHk25  : ------------------------------------------------------------ :   -
LpMDHk26  : ------------------------------------------------------------ :   -
LpMDHk27  : ------------------------------------------------------------ :   -
LpMDHk28  : ------------------------------------------------------------ :   -
LpMDHk29  : ------------------------------------------------------------ :   -
LpMDHk30  : ------------------------------------------------------------ :   -
LpMDHk31  : ------------------------------------------------------------ :   -
LpMDHk32  : ------------------------------------------------------------ :   -
LpMDHk33  : ------------------------------------------------------------ :   -
LpMDHk34  : ------------------------------------------------------------ :   -
LpMDHk35  : ------------------------------------------------------------ :   -
LpMDHk36  : ------------------------------------------------------------ :   -
LpMDHk37  : ------------------------------------------------------------ :   -
LpMDHk38  : ------------------------------------------------------------ :   -
LpMDHk39  : ------------------------------------------------------------ :   -
LpMDHk40  : ------------------------------------------------------------ :   -
LpMDHk41  : ------------------------------------------------------------ :   -
LpMDHk42  : ------------------------------------------------------------ :   -
LpMDHk43  : ------------------------------------------------------------ :   -
LpMDHk44  : ------------------------------------------------------------ :   -
LpMDHk45  : ------------------------------------------------------------ :   -
LpMDHk46  : ------------------------------------------------------------ :   -
LpMDHk47  : ------------------------------------------------------------ :   -
LpMDHk48  : ------------------------------------------------------------ :   -
LpMDHk49  : ------------------------------------------------------------ :   -
LpMDHk50  : ------------------------------------------------------------ :   -
LpMDHk51  : ------------------------------------------------------------ :   -
LpMDHk52  : ------------------------------------------------------------ :   -
LpMDHk53  : ------------------------------------------------------------ :   -
LpMDHk54  : ------------------------------------------------------------ :   -
LpMDHk55  : ------------------------------------------------------------ :   -
LpMDHk56  : ------------------------------------------------------------ :   -
LpMDHk57  : ------------------------------------------------------------ :   -
LpMDHk58  : ------------------------------------------------------------ :   -
LpMDHk59  : ------------------------------------------------------------ :   -
LpMDHk60  : ------------------------------------------------------------ :   -
LpMDHk61  : ------------------------------------------------------------ :   -
LpMDHk62  : ------------------------------------------------------------ :   -
LpMDHk63  : ------------------------------------------------------------ :   -
LpMDHk64  : ------------------------------------------------------------ :   -
LpMDHk65  : ------------------------------------------------------------ :   -
LpMDHk66  : GACCTGGAGGGAGTGACGGAGTACGAGGCCAAGGCGCTTGANGCATTGAAGGCTGAGCTG : 774
```

FIGURE 7 (cont.)

```
LpMDHk1   : --- : -
LpMDHk2   : --- : -
LpMDHk3   : --- : -
LpMDHk4   : --- : -
LpMDHk5   : --- : -
LpMDHk6   : --- : -
LpMDHk7   : --- : -
LpMDHk8   : --- : -
LpMDHk9   : --- : -
LpMDHk10  : --- : -
LpMDHk11  : --- : -
LpMDHk12  : --- : -
LpMDHk13  : --- : -
LpMDHk14  : --- : -
LpMDHk15  : --- : -
LpMDHk16  : --- : -
LpMDHk17  : --- : -
LpMDHk18  : --- : -
LpMDHk19  : --- : -
LpMDHk20  : --- : -
LpMDHk21  : --- : -
LpMDHk22  : --- : -
LpMDHk23  : --- : -
LpMDHk24  : --- : -
LpMDHk25  : --- : -
LpMDHk26  : --- : -
LpMDHk27  : --- : -
LpMDHk28  : --- : -
LpMDHk29  : --- : -
LpMDHk30  : --- : -
LpMDHk31  : --- : -
LpMDHk32  : --- : -
LpMDHk33  : --- : -
LpMDHk34  : --- : -
LpMDHk35  : --- : -
LpMDHk36  : --- : -
LpMDHk37  : --- : -
LpMDHk38  : --- : -
LpMDHk39  : --- : -
LpMDHk40  : --- : -
LpMDHk41  : --- : -
LpMDHk42  : --- : -
LpMDHk43  : --- : -
LpMDHk44  : --- : -
LpMDHk45  : --- : -
LpMDHk46  : --- : -
LpMDHk47  : --- : -
LpMDHk48  : --- : -
LpMDHk49  : --- : -
LpMDHk50  : --- : -
LpMDHk51  : --- : -
LpMDHk52  : --- : -
LpMDHk53  : --- : -
LpMDHk54  : --- : -
LpMDHk55  : --- : -
LpMDHk56  : --- : -
LpMDHk57  : --- : -
LpMDHk58  : --- : -
LpMDHk59  : --- : -
LpMDHk60  : --- : -
LpMDHk61  : --- : -
LpMDHk62  : --- : -
LpMDHk63  : --- : -
LpMDHk64  : --- : -
LpMDHk65  : --- : -
LpMDHk66  : AAG : 777
```

FIGURE 7 (cont.)

```
                       *         20         *         40         *         60
LpPEPCb1 : GAAGAAGTTGCTGATGTTTTAAGNACATTTNTGTCCTTGCAGAGCTCCCAGCAGATTGTT :  60
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ------------------------------------------------------------ :   -
LpPEPCb6 : ------------------------------------------------------------ :   -

*         80         *        100         *        120
LpPEPCb1 : TTGGTGCTTACATCATCTCAATGGCAACTGCCCCATCTGATGTGCTTGCTGTTGAGCTTT : 120
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ------------------------------------------------------------ :   -
LpPEPCb6 : ------------------------------------------------------------ :   -

*        140         *        160         *        180
LpPEPCb1 : TGCAGCGGGAGTGCCATATAAAAAAGCCATTGAGAGTTGTTCCACTATTTGAAAAGCTTG : 180
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ------------------------------------------------------------ :   -
LpPEPCb6 : ------------------------------------------------------------ :   -

*        200         *        220         *        240
LpPEPCb1 : CAGATCTTGAANCAGCTCCAGCATCTGTTGCACGACTATTTTCAATAGACTGGTACATGA : 240
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ------------------------------------------------------------ :   -
LpPEPCb6 : ------------------------------------------------------------ :   -

*        260         *        280         *        300
LpPEPCb1 : ATAGAATCAATGGCAAGCAGGAGGTCATGATTGGATACTCAGACTCTGGGAAGGACGCTG : 300
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ------------------------------------------------------------ :   -
LpPEPCb6 : ------------------------------------------------------------ :   -

*        320         *        340         *        360
LpPEPCb1 : GGCGTCTCTCTGCAGCGTGGCAAATGTATAAAGCACAAGAAGATCTCATAAAGGTGGCAA : 360
LpPEPCb2 : -------------------------GTATAAAGCACAAGAAGATCTCATAAAGGTGGCAA :  35
LpPEPCb3 : ------------------------------------------------------------ :   -
LpPEPCb4 : ------------------------------------------------------------ :   -
LpPEPCb5 : ------------------------------------------------------------ :   -
LpPEPCb6 : ------------------------------------------------------------ :   -

*        380         *        400         *        420
LpPEPCb1 : AGCAATATGGAGTAAAGTTAACAATGTTTCATGGAAGAGGTGGAACGGTTGGCAGAGGAG : 420
LpPEPCb2 : AGCAATATGGAGTAAAGTTAACAATGTTTCATGGAAGAGGTGGAACGGTTGGCAGAGGAG :  95
LpPEPCb3 : ---------------------------AATGTTT-NTGGAAGAGGTGGAACGGTTGGCAGAGGAG :  37
LpPEPCb4 : ------------------------------------------------------GCANAGGAG :   9
LpPEPCb5 : ------------------------------------------------------------ :   -
LpPEPCb6 : ------------------------------------------------------------ :   -
```

FIGURE 8

```
                       *         440         *         460         *         480
LpPEPCb1 : GTGGTCCCAGTCATCTTGCTATATTATCTCAACCACCAGACACGATACAAGGATCACTTC : 480
LpPEPCb2 : GTGGTCCCAGTCATCTTGCTATATTATCTCAACCACCAGACACGATACAAGGATCACTTC : 155
LpPEPCb3 : GTGGTCCCAGTCATCTTGCTATATTATCTCAACCACAGACACGATACAAGGATCACTTC  :  97
LpPEPCb4 : GTGGTCCCAGTCATCTTGCTATATTATCTCAACCACCAGACACGATACAAGGATCACTTC :  69
LpPEPCb5 : ------------------------------------------------------------ :   -
LpPEPCb6 : ------------------------------------------------------------ :   -

*         500         *         520         *         540
LpPEPCb1 : GTGTAACAGTTCAAGGCGAGGTCATAGAGCACTCATTTGGAGAGGAACACTTGTGCTTCA : 540
LpPEPCb2 : GTGTAACAGTTCAAGGCGAGGTCATAGAGCACTCATTTGGAGGGAACACTTGTGCTTCA  : 215
LpPEPCb3 : GTGTAACAGTTCAAGGCGAGGTCATAGAGCACTCATTTGGAGAGGAACACTTGTGCTTCA : 157
LpPEPCb4 : GTGTAACAGTTCAAGGCGAGGTCATAGAGCACTCATTTGGAGAGGAACACTTGTGCTTCA : 129
LpPEPCb5 : ------------------------------------------------------------ :   -
LpPEPCb6 : ------------------------------------------------------------ :   -

*         560         *         580         *         600
LpPEPCb1 : NAACTCTGCAACGTTTCACTGCAGCTACTCTTGAGCATGGAATGCATCCTCCAATTTCNC : 600
LpPEPCb2 : GAACTCTGCAACGTTTCACTGCAGCTACTCTTGAGCATGGAATGCATCCTCCAATTTCAC : 275
LpPEPCb3 : GAACTCTGCAACGTTTCACTGCAGCTACTCTTGAGCATGGAATGCATCCTCCAATTTCAC : 217
LpPEPCb4 : GAACTCTGCAACGTTTCACTGCAGCTACTCTTGAGCATGGAATGCATCCTCCAATTTCAC : 189
LpPEPCb5 : ------------------------------------------------------------ :   -
LpPEPCb6 : ------------------------------------------------------------ :   -

*         620         *         640         *         660
LpPEPCb1 : CCAANCCAGAATGGCNTGCTATAATGGATGANATGGCTGTAGNGGCANCAAAAGAANATC : 660
LpPEPCb2 : CCAAGCCAGAATGGCGTGCTATAATGGATGAGATGGCTGTAGTGGCAACAAAAGAATATC : 335
LpPEPCb3 : CCAAGCCAGAATGGCGTGCTATAATGGATGAGATGGCTGTAGTGGCAACAAAAGAATATC : 277
LpPEPCb4 : CCAAGCCAGAATGGCGTGCTATAATGGATGAGATGGCTGTAGTGGCAACAAAAGAATATC : 249
LpPEPCb5 : ------------------------------------------------------------ :   -
LpPEPCb6 : ------------------------------------------------------------ :   -

*         680         *         700         *         720
LpPEPCb1 : GATCAATTGNCTTCCAAGAACCNCNTTTTGNCNAATA----------------------- : 697
LpPEPCb2 : GATCAATTGTCTTCCAAGAACCACGTTTTGTCGAATACTTCCGCTCGGCAACACCTGAGA : 395
LpPEPCb3 : GATCAATTGTCTTCCAAGAACCACGTTTTGTCGAATACTTCCGCTCGGCAACACCTGAGA : 337
LpPEPCb4 : GATCAATTGTCTTCCAAGAACCACGTTTTGTCGAATACTTCCGCTCGGCAACACCTGAGA : 309
LpPEPCb5 : ------------------------------------------------------------ :   -
LpPEPCb6 : ------------------------------------------------------------ :   -

*         740         *         760         *         780
LpPEPCb1 : ------------------------------------------------------------ :   -
LpPEPCb2 : CTGAATATGGTCGGATGAATATTGGTAGCCGGCCATCAAAGAGAAAGCCTAGTGGAGGCA : 455
LpPEPCb3 : CTGAATATGGTCGGATGAATATTGGTAGCCGGCCATCAAAGAGAAAGCCTAGTGGAGGCA : 397
LpPEPCb4 : CTGAATATGGTCGGATGAATATTGGTAGCCGGCCATCAAAGAGAAAGCCTAGTGGAGGCA : 369
LpPEPCb5 : ------------------------------------------------------------ :   -
LpPEPCb6 : ------------------------------------------------------------ :   -

*         800         *         820         *         840
LpPEPCb1 : ------------------------------------------------------------ :   -
LpPEPCb2 : TAGAATCGCTCCGTGCAATTCCATGGATCTTTGCTTGGACACAGACAAGGTTTCATCTTC : 515
LpPEPCb3 : TAGAATCGCTCCGTGCAATTCCATGGATCTTTGCTTGGACACAGACAAGGTTTCATCTTC : 457
LpPEPCb4 : TAGAATCGCTCCGTGCAATTCCATGGATCTTTGCTTGGACACAGACAAGGTTTCATCTTC : 429
LpPEPCb5 : ------------------------------------------------------------ :   -
LpPEPCb6 : ------------------------------------------------------------ :   -
```

FIGURE 8 (cont.)

```
              *         860         *         880         *         900
LpPEPCb1 : ------------------------------------------------------------ :   -
LpPEPCb2 : CTGTATGGCTTGGATTTGGTGCAGCGTTCAAACATATCATGCAGAAGGACATCAGGAATA : 575
LpPEPCb3 : CTGTATGGCTTGGATTTGGTGCAGCGTTCAAACATATCATGCAGAAGGACATCAGGAATA : 517
LpPEPCb4 : CTGTATGGCTTGGATTTGGTGCAGCGTTCAAACATATCATGCAGAAGGACATCAGGAATA : 489
LpPEPCb5 : ------------------------------------------------------------ :   -
LpPEPCb6 : ------------------------------------------------------------ :   -

*         920         *         940         *         960
LpPEPCb1 : ------------------------------------------------------------ :   -
LpPEPCb2 : TCCATACTCTGAAAGAAATGTACAATGAGTGGCCATTCTTTAGGGTCACCCTTGACTTGC : 635
LpPEPCb3 : TCCATACTCTGAAAGAAATGTACAATGAGTGGCCATTCTTTAGGGTCACCCTTGACTTGC : 577
LpPEPCb4 : TCCATACTCTGAAAGAAATGTACAATGAGTGGCCATTCTTTAGGGTCACCCTTGACTTGC : 549
LpPEPCb5 : ------------------------------------------------------------ :   -
LpPEPCb6 : ------------------------------------------------------------ :   -

*         980         *        1000         *        1020
LpPEPCb1 : ------------------------------------------------------------ :   -
LpPEPCb2 : TTGAGATGGTTTTTGCCAAGGGAGATCCAGGAATTGCTGCTTTATATGACAAATTGCTTG : 695
LpPEPCb3 : TTGAGATGGTTTTTGCCAAGGGAGATCCAGGGATTGCTGCTTTATATGACAAATTGCTTG : 637
LpPEPCb4 : TTGAGATGGTTTTTGCCAAGGGAGATCCAGGAATTGCTGCTTTATATGACAAATTGCTTG : 609
LpPEPCb5 : -------GGTTTTTG-CNAGGGAGATCC-GG-ATTGCTGCTTTATATGACAAATTGCTTG :  50
LpPEPCb6 : ------------------------------------------------------------ :   -

*        1040         *        1060         *        1080
LpPEPCb1 : ------------------------------------------------------------ :   -
LpPEPCb2 : TGTCTGAAGATCTGCAGCCCTTTGGGGAGCAGCTGANAAACAACTTTGAAGAGACGAAAC : 755
LpPEPCb3 : TGTCTGAAGATCTGCAGCCCTTTGGGGAGCAGCTGAGAAACAACTTTGAAGAGACGAAAC : 697
LpPEPCb4 : TGTCTGAAGATCTGCAGCCCTTTGGGGAGCAGCTGAGAAACAACTTTGAAGAGACGAAAC : 669
LpPEPCb5 : TGTCTGAAGATCTGCAGCCCTTTGGGGAGCNGCTGAGAAACAACTTTGAAGAGACGAAAC : 110
LpPEPCb6 : ------------------------------------------------------------ :   -

*        1100         *        1120         *        1140
LpPEPCb1 : ------------------------------------------------------------ :   -
LpPEPCb2 : AGNTACTCTTTAAGGTTGTTGNCCACAAGG------------------------------ : 785
LpPEPCb3 : AGTTACTCCTTCAGGTTGCTGGCCACAAGGACGTTCTTGAAGGGGATCCTTACCTGAAGC : 757
LpPEPCb4 : AGTTACTCCTTCAGGTTGCTGGCCACAAGGACGTTCTTGAGGGGGATCCTTACCTGAAGC : 729
LpPEPCb5 : AGTTACTCCTTCAGGTTGCTGGCCACAAGGACGTTCTTGAAGGGGATCCTTACCTGAAGC : 170
LpPEPCb6 : --------------------------GGACGTTCTTGAAGGGGATCCTTACCTGAAGC :  32

*        1160         *        1180         *        1200
LpPEPCb1 : ------------------------------------------------------------ :   -
LpPEPCb2 : ------------------------------------------------------------ :   -
LpPEPCb3 : AGCGTCTGCGGTTGCGTGAGTCATAC---------------------------------- : 783
LpPEPCb4 : AGCGTCTGCGGTTGCGTGAGTCATACATCACAACA------------------------- : 764
LpPEPCb5 : AGCGTCTGCGGTTGCGTGAGTCATACATCACAACATTGAATGTTTGCCAAGCCACACCC : 230
LpPEPCb6 : AGCGTCTGCGGTTGCGTGAGTCATACATCACAACATTGAATGTTTGCCAAGCNNCACCC :  92

*        1220         *        1240         *        1260
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : TGAAGCGGATAAGAGACCCTAGCTTCGAGGTGACACCGCAGCAGGCACCTCTGTCGAAGG : 290
LpPEPCb6 : TGAAGCGGATAAGAGACCCTAGCTTCGAGGTGACACCGCAGCAGGCACCTCTGTCGAAGG : 152
```

FIGURE 8 (cont.)

```
              *         1280         *         1300         *         1320
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : AGTTCGCTGATGAGAAGGAGCCAGCTGAGCTGGTGCAACTGAACCGTGGGAGCGAGTACG : 350
LpPEPCb6 : AGTTCGCTGATGAGAAGGAGCCAGCTGAGCTGGTGCAACTGAACCGTGGGAGCGAGTACG : 212

*         1340         *         1360         *         1380
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : CCCCAGGCCTGGAGGACACCCTCATCCTTACCATGAAGGGTA-TTGCTGTGGAATGCAAA : 409
LpPEPCb6 : CCCCAGGCCTGGAGGACACCCTCATCCTTACCATGAAGGGTATTTGCTGTGGAATGCAAA : 272

*         1400         *         1420         *         1440
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ACACAGGCTAGGCCAGTTTGCCTA-TTGGAATAACTGTCATCCGTCAGATGGGGCGTGA : 468
LpPEPCb6 : ACACAGGCTAGGCCAGTTTGCCTATTTGGAATAACTGTCATCCCGTCAGAT-GGGCGTGA : 331

*         1460         *         1480         *         1500
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ATATGTGTGTTCCCCAAATGCTAGTGAACCCTGGAGGCATTTTGGCCACTTACATGCCTT : 528
LpPEPCb6 : ATATGTGTGTTCCCCAAATGCTAGTGAACCCTGGAGGCA-TTTGGCCACTTACATGCCTT : 390

*         1520         *         1540         *         1560
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : TTGGTTATGNATGNAC-TTGATCTTAATGNCAAGGGTTGTTGAAGCCTGATCTAAATAAA : 587
LpPEPCb6 : TTGGTTATGGATGNACTTTGATCTTAATGCCAANGGTTGTTGAAGCCTGATCTAAATNAA : 450

*         1580         *         1600         *         1620
LpPEPCb1 : ------------------------------------------------------------ :   -
LpPEPCb2 : ------------------------------------------------------------ :   -
LpPEPCb3 : ------------------------------------------------------------ :   -
LpPEPCb4 : ------------------------------------------------------------ :   -
LpPEPCb5 : ATATGGAACAATGATATTCTGG-NGGATCTAATAATTTGCTTGGCTCTGGCATCGNAATA : 646
LpPEPCb6 : ATATGGAACAATGATATTCTGGTGCTTCTTA----------------------------- : 482

*         1640
LpPEPCb1 : -------------------- :   -
LpPEPCb2 : -------------------- :   -
LpPEPCb3 : -------------------- :   -
LpPEPCb4 : -------------------- :   -
LpPEPCb5 : GNGATTTGGAGTNGTTTAAC : 666
LpPEPCb6 : -------------------- :   -
```

```
              *         260         *         280         *         300
TrMDHa1  : ------------------------------------------------------------ :   -
TrMDHa2  : GCTGCATTCCCTCTTCTTAAAGGAGTTGTTGCTACCACTGATGTGGTTGAGGCATGCACT : 299
TrMDHa3  : GCTGCATTCCCTCTTCTTAAAGGAGTTGTTGCTACAACTGATGTGGTTGAGGCATGCACT : 297
TrMDHa4  : GCTGCATTCCCTCTTCTTAAAGGAGTTGTTGCTACAACTGATGTGGTTGAGGCATGCACT : 297
TrMDHa5  : GCTGCATTCCCTCTTCTTAAAGGAGTTGTTGCTACAACTGATGTGGTTGAGGCATGCACT : 295
TrMDHa6  : GCTGCATTCCCTCTTCTTAAAGGAGTTGTTGCTACAACTGATGTGGTTGAGGCATGCACT : 294
TrMDHa7  : GCTGCATTCCCTCTTCTTAAAGGAGTTGTTGCTACAACTGATGTGGTTGAGGCATGCACT : 284
TrMDHa8  : GCTGCATTCCCTCTTCTTAAAGGAGTTGTTGCTACAACTGATGTGGTTGAGGCATGCACT : 283
TrMDHa9  : GCTGCATTCCCTCTTCTTAAAGGAGTTGTTGCTACAACTGATGTGGTTGAGGCATGCACT : 279
TrMDHa10 : GCTGCATTCCCTCTTCTTAAAGGAGTTGTTGCTACAACTGATGTGGTTGAGGCATGCACT : 280
TrMDHa11 : GCTGCATTCCCTCTTCTTAAAGGAGTTGTTGCTACAACTGATGTGGTTGAGGCATGCACT : 281

*         320         *         340         *         360
TrMDHa1  : ------------------------------------------------------------ :   -
TrMDHa2  : GGCGTCAATATTGCCGTTATGGTTGGCGGGTTCCCTAGAAAAGAAGGTATGGAGAGGAAA : 359
TrMDHa3  : GGTGTCAATATTGCCGTTATGGTTGGTGGGTTCCCTAGAAAAGAAGGTATGGAGAGGAAA : 357
TrMDHa4  : GGTGTCAATATTGCCGTTATGGTTGGTGGGTTCCCTAGAAAAGAAGGTATGGAGAGGAAA : 357
TrMDHa5  : GGTGTCAATATTGCCGTTATGGTTGGTGGGTTCCCTAGAAAAGAAGGTATGGAGAGGAAA : 355
TrMDHa6  : GGTGTNAATATTGACGNTATGGNTGGNGGGTTNCNTACNANACAAGGTNT---------- : 344
TrMDHa7  : GGTGTCAATATTGCCGTTATGGTTGGTGGGTTCCCTAGAAAAGAAGGTATGGAGAGGAAA : 344
TrMDHa8  : GGTGTCAATATTGCCGTTATGGTTGGTGGGTTCCCTAGAAAAGAAGGTATGGAGAGGAAA : 343
TrMDHa9  : GGTGTCAATATTGCCGTTATGGTTGGTGGGTTCCCTAGAAAAGAAGGTATGGAGAGGAAA : 339
TrMDHa10 : GGTGTCAATATTGCCGTTATGGTTGGTGGGTTCCCTAGAAAAGAAGGTATGGAGAGGAAA : 340
TrMDHa11 : GGTGTCAATATTGCCGTTATGGTTGGTGGGTTCCCTANAAAAGAANGTATGGAGAGGAAA : 341

*         380         *         400         *         420
TrMDHa1  : ------------------------------------------------------------ :   -
TrMDHa2  : GATGTGATGACAAAAAATGTCTCTATTTACAAGTCTCAGGCTTCTGCCCTTGAAAAACAT : 419
TrMDHa3  : GATGTGATGACAAAAAATGTCTCTATTTACAAGTCTCAGGCTTCTGCCCTTGAAAAACAT : 417
TrMDHa4  : GATGTGATGACAAAAAATGTCTCTATTTACAAGTCTCAGGCTTCTGCCCTTGAAAAACAT : 417
TrMDHa5  : GATGTGATGACAAAAAATGTCTCTATTTACAAGTCTCAGGCTTCTGCCCTTGAAAAACAT : 415
TrMDHa6  : ------------------------------------------------------------ :   -
TrMDHa7  : GATGTGATGACAAAAAATGTCTCTATTTACAAGTCTCAGGCTTCTGCCCTTGAAAAACAT : 404
TrMDHa8  : GATGTGATGACAAAAAATGTCTCTATTTACAAGTCTCAGGCTTCTGCCCTTGAAAAACAT : 403
TrMDHa9  : GATGTGATGACAAAAAATGTCTCTATTTACAAGTCTCAGGCTTCTGCCCTTGAAAAACAT : 399
TrMDHa10 : GATGTGATGACAAAAAATGTCTCTATTTACAAGTCTCAGGCTTCTGCCCTTGAAAAACAT : 400
TrMDHa11 : GATGTGATGAC-AAAAATGTCTCTATTTACAAGTCTNANGCTTNTGNCCTTGAAAAACAT : 400

*         440         *         460         *         480
TrMDHa1  : ------------------------------------------------------------ :   -
TrMDHa2  : GCTGCTGCAAACTGCAAGGTTCTTGTTGTTGCCAACCCAGCAAACACCAATGCATTGATC : 479
TrMDHa3  : GCTGCTGCAAACTGCAAGGTTCTTGTTGTTGCCAACCCAGCAAACACCAATGCATTGATC : 477
TrMDHa4  : GCTGCTGCAAACTGCAAGGTTCTTGTTGTTGCCAACCCAGCAAACACCAATGCATTGATC : 477
TrMDHa5  : GCTGCTGCAAACTGCAAGGTTCTTGTTGTTGCCAACCCAGCAAACACCAATGCATTGATC : 475
TrMDHa6  : ------------------------------------------------------------ :   -
TrMDHa7  : GCTGCTGCAAACTGCAAGGTTCTTGTTGTTGCCAACCCAGCAAACACCAATGCATTGATC : 464
TrMDHa8  : GCTGCTGCAAACTGCAAGGTTCTTGTTGTTGCCAACCCAGCAAACACCAATGCATTGATC : 463
TrMDHa9  : GCTGCTGCAAACTGCAAGGTTCTTGTTGTTGCCAACCCAGCAAACACCAATGCATTGATC : 459
TrMDHa10 : GCTGCTGCAAACTGCAAGGTTCTTGTTGTTGCCAACCCAGCAAACACCAATGCATTGATC : 460
TrMDHa11 : GCTGCTGCAAACTGCAAGGTTCTTGTTGTTGNCAACCCACCAAACACCAATGCATTGATC : 460
```

FIGURE 9 (cont.)

```
              *         500         *         520         *         540
TrMDHa1  : ------------------------------------------------------------ :   -
TrMDHa2  : TTGAAGGAATATGCTCCATCCATTCCTGAGAAAAACATTTCTGCTTTGACTAGATTGGAC : 539
TrMDHa3  : TTGAAGGAATATGCTCCATCCATTCCTGAGAAAAACATTTCTGCTTTGACTAGATTGGAC : 537
TrMDHa4  : TTGAAGGAATATGCTCCATCCATTCCTGAGAAAAACATTTCTGCTTTGACTAGATTGGAC : 537
TrMDHa5  : TTGAAGGAATATGCTCCATCCATTCCTGAGAAAAACATTTCTGCTTTGACTAGATTGGAC : 535
TrMDHa6  : ------------------------------------------------------------ :   -
TrMDHa7  : TTGAAGGAATATGCTCCATCCATTCCTGAGAAAAACATTTCTGCTTTGACTAGATTGGAC : 524
TrMDHa8  : TTGAAGGAATATGCTCCATCCATTCCTGAGAAAAACATTTCTGCTTTGACTAGATTGGAC : 523
TrMDHa9  : TTGAAGGAATATGCTCCATCCATTCCTGAGAAAAACATTTCTGCTTTGACTAGATTGGAC : 519
TrMDHa10 : TTGAAGGAATATGCTCCATCCATTCCTGAGAAAAACATTTCTGCTTTGACTAGATTGGAC : 520
TrMDHa11 : TTGAAGGAATATGCTCCATNCATTCCTGANAAAAACATTTNTGCTTTGACTAGATTGGAC : 520

*         560         *         580         *         600
TrMDHa1  : ------------------------------------------------------------ :   -
TrMDHa2  : CATAACAGGGCACTNGGTCA---------------------------------------- : 559
TrMDHa3  : CATAACAGGGCACTAGGTCAAATTTCTGAA------------------------------ : 567
TrMDHa4  : CATAACAGGGCACTAGGTCAAATTTCTGAAAGACTAAA---------------------- : 575
TrMDHa5  : CATAACAGGGCACTAGGTCAAATTTCTGAAAGACTAAACGTTGAAGTTTCTGATGTGAAA : 595
TrMDHa6  : ------------------------------------------------------------ :   -
TrMDHa7  : CATAACAGGGCACTAGGTCAAATTTCTGAAAGAC-------------------------- : 558
TrMDHa8  : CATAACAGGGCACTAGGTCAAATTTCTGAAAGACTAAACGTTGAAGTTTCTGATGTGAAA : 583
TrMDHa9  : CATAACAGGGCACTAGGTCAAATTTCTGAAAGACTAAACGTTGAAGTTTCTGATGTGC-- : 577
TrMDHa10 : CATAACAGGGCACTAGGTCAAATTTCTGAAAGACTAAACGTTGAAGTTTCTGATGTGAAA : 580
TrMDHa11 : CATAACAGGGCACTAGGCCAAATTTNTGAAANACTAAACGTTGAAGTTTNTGATGTGAAA : 580

*         620         *         640         *         660
TrMDHa1  : ------------------------------------------------------------ :   -
TrMDHa2  : ------------------------------------------------------------ :   -
TrMDHa3  : ------------------------------------------------------------ :   -
TrMDHa4  : ------------------------------------------------------------ :   -
TrMDHa5  : AATGTTAT-A-AT----------------------------------------------- : 606
TrMDHa6  : ------------------------------------------------------------ :   -
TrMDHa7  : ------------------------------------------------------------ :   -
TrMDHa8  : AATGTTATAATNTGGG-------------------------------------------- : 599
TrMDHa9  : ------------------------------------------------------------ :   -
TrMDHa10 : AATGTTATAATNTG---------------------------------------------- : 594
TrMDHa11 : AATGTTAT-ATATGGGGGAAATNATTCATCAACTCAATACCCTGNTGTNAACCACNCAAC : 639

*
TrMDHa1  : ---------------  :   -
TrMDHa2  : ---------------  :   -
TrMDHa3  : ---------------  :   -
TrMDHa4  : ---------------  :   -
TrMDHa5  : ---------------  :   -
TrMDHa6  : ---------------  :   -
TrMDHa7  : ---------------  :   -
TrMDHa8  : ---------------  :   -
TrMDHa9  : ---------------  :   -
TrMDHa10 : ---------------  :   -
TrMDHa11 : CGTTAAAATCTCCT   : 653
```

FIGURE 9 (cont.)

```
              *        20         *        40         *        60
TrMDHb1  : TTCTCCCNNAATCNNGAAANC-NCGC-ACA-CA-ACA-C-TAA-ACT--ACT-A-C-T-C : 47
TrMDHb2  : TTCTCNCANAATCNNGAAANC-CCGC-A-A--A-ACA-C-TAA-ACT--ACT-A-C-T-C : 45
TrMDHb3  : ---------------GNNACCACAA-CACA-ACA-CA-NCA-C-TAA-CCCT--CACT-C--TC : 37
TrMDHb4  : --------------------GTT-NTCA-ACA-ACA-C-TCAC-CCTTNCTNN-C-T-C : 32
TrMDHb5  : --------------------GCNCANACATAACACAACACTAAACCT-NA-CT--NCTC : 35
TrMDHb6  : ------------------------GCAA-ACA-CA-ACA-C-TAA-CCT-NACT-N-C--TC : 27
TrMDHb7  : -------------------------TTT-ACG-TA-ACC-C-TAN-ACTCCACT-N-C-TTC : 28
TrMDHb8  : ---------------------------G-NA-CCACC-TAAC-CCTCACTNN-C-TNC : 25
TrMDHb9  : --------------------------------CN-A-NCC-TC----ACT-A-C-TNC : 16
TrMDHb10 : -------------------------------CAN-CACTAAACC--TA-CT-CNCAC : 21
TrMDHb11 : --------------------------------CAAACA-CACCT-AACCTAC-TNC : 21
TrMDHb12 : --------------------------------AACACTAAACCC-TA-CTNCTCTC : 22
TrMDHb13 : ---------------------------------CN-TAAC-CCTNACTCN-C-T-C : 18
TrMDHb14 : ----------------------------------G-TCA-TC---ACT-N-C-TNC : 14
TrMDHb15 : ----------------------------------CACTAAACCT-NN-CTNCTCTC : 20
TrMDHb16 : ----------------------------------CNA-CACNTAAACTNC-TNC : 20
TrMDHb17 : ------------------------------------ACCACNTAACCCT-CCTNC : 18
TrMDHb18 : ------------------------------------A-CACNT-AACCTNC-TNC : 16
TrMDHb19 : --------------------------------------CTANCCT-CACTC : 12
TrMDHb20 : ----------------------------------------GCA-T-C--TC : 7
TrMDHb21 : --------------------------------------------TCAC : 4
TrMDHb22 : ----------------------------------------------TC : 2
TrMDHb23 : ------------------------------------------------ : -
TrMDHb24 : ------------------------------------------------ : -
TrMDHb25 : ------------------------------------------------ : -
TrMDHb26 : ------------------------------------------------ : -
TrMDHb27 : ------------------------------------------------ : -
TrMDHb28 : ------------------------------------------------ : -
TrMDHb29 : ------------------------------------------------ : -
TrMDHb30 : ------------------------------------------------ : -
TrMDHb31 : ------------------------------------------------ : -
TrMDHb32 : ------------------------------------------------ : -
```

FIGURE 10

```
                        *          80         *        100         *        120
TrMDHb1  : TCT---AAACAAAACTGTTCTTCCTCTCTTAATCTTCCCTGTTCGATTCCTTCCAGTTCT : 104
TrMDHb2  : TCT---AAACAAAACTGTTCTTCCTCTCTTAATCTTCCCTGTTCGATTCCTTCCAGTTCT : 102
TrMDHb3  : TNA---AACAAAACTGTTCTTCCACTCTTAATCTTCCCTGTTCGATTCCTTCTATTTCT :  94
TrMDHb4  : TCT-NAAACAAANGCTATTCTTCATCTCTTAATCTTCGCGGTTCGATTCCTTCCGTTTCT :  91
TrMDHb5  : TCT-N-AA-NAAAACTGTTCTTCCTCTCTTAATCTTCCCTGTTCGATTCCTTCC-GTTCT :  91
TrMDHb6  : TCT---NAACAAAACTATTCTTCATCTCTTAATCTTCCCGGTTCGATTCCTTCCGGGTCT :  84
TrMDHb7  : TNN---AACAAAACTATTCTTNATCTCTTAATCTTCGCGGTTCGATTCCTTCCGTTTCT :  85
TrMDHb8  : TCT-NNAACAAAAACTATTCTTCTCTCTTAATCTTCGCGGTTCGATTCCTTCCGTTTCT :  84
TrMDHb9  : TCN---AACAAAACTGTTCTTCC-CTCTTAATCTTCCCTGTTCGATTCCTTCTATTTCT :  72
TrMDHb10 : TCTCA-AAC-AAAACTGNTCTTCCTCTCTTAA-CTTCCCTGTTCGATTCCTTCCAGTTCT :  78
TrMDHb11 : TCTCTNAAC-AAAACTGTTCTTCCTCTCTTAATCTTCCCTGTTCGATTCCTTCCAGTTCT :  80
TrMDHb12 : TCTCT-NAACAAAACTGTTCTTCCTCTCTTNATCTTCCCTGTTCGATTCCTTCCAGTTCT :  81
TrMDHb13 : TCT-N-AAANAAAACTATTCTT-ATCTCTTAATCTTCGCGGTTCGATTCCTTCCGTTTCT :  75
TrMDHb14 : TNC---AANAAAACTGTTCTTCCACTCTTAATCTTCCCTGTTCGATTCCTTCTATTTCT :  71
TrMDHb15 : TCTCT-AAACAAAACTGTTCTTCCTCTCTTAATCTTCCCTGTTCGATTCCTTCCAGTTCT :  79
TrMDHb16 : TCTCTNAAC-AAAACTGTTCTTCCTCTCTTNATCTTCCCTGTTCGATTCCTTCC-GTTCT :  78
TrMDHb17 : TCT-CAAACAAAAACTGTTCTTC-CCTCTTAATCTTCCCTGTTCGATTCCTTCTATTTCT :  76
TrMDHb18 : TCTCTCAAC-AAAACTGTTCTTCCTCTCTTAATCTTCCCTGTTCGATTCCTTCC-GTTCT :  74
TrMDHb19 : TCT-NNAACAAAAACTGTTCTTC-CCTCTTAATCTTCCCTGTTCGATTCCTTCTATTTCT :  70
TrMDHb20 : TNA---AACAAAAACTGTTCTT-CNCTCTTAATCTTCCCTGTTCGATTCCTTCTATTTCT :  63
TrMDHb21 : CCTCTNAACAAAAACTGTTCTTCCTCTCCCTTNATCTTCCCTGTTCGATTCCTTCC-GTTCT :  63
TrMDHb22 : TCT--NAACAAAAACTGTTCTTC-CCTCTTNATCTTCCCTGTTCGATTCCTTCTATTTCT :  59
TrMDHb23 : --------CAAAAACTGCTCTTCCTCTCTTNATCTTCCCTGTTCGATTCCTTCC-GTTCT :  51
TrMDHb24 : ----------AAAACTGTTCTTCCTCTCTTNATCTTCCCTGTTCGATTCCTTCC-GTTCT :  49
TrMDHb25 : --------------CNNTTCTTCCTCTCTTCAACTTCCCTGTTCGATTCCTTCCAGTTCT :  46
TrMDHb26 : ---------------GGTTCTTC-CCTCTTANCTTCCCTGTTCGATTCCTTCTATTTCT :  44
TrMDHb27 : -------------------TTCCTCTCTTNATCTTCCCTGTTCGATTCCTTCC-GTTCT :  39
TrMDHb28 : ------------------------------------------------------------ :   -
TrMDHb29 : ------------------------------------------------------------ :   -
TrMDHb30 : ------------------------------------------------------------ :   -
TrMDHb31 : ------------------------------------------------------------ :   -
TrMDHb32 : ------------------------------------------------------------ :   -
```

FIGURE 10 (cont.)

```
                       *         140         *         160         *         180
TrMDHb1  : TCAAAAATGGCCAAAGACCCAGTTCGTGTTCTCGTCACTGGTGCTGCAGGGCAAATTGGT : 164
TrMDHb2  : TCAAAAATGGCCAAAGACCCAGTTCGTGTTCTCGTCACTGGTGCTGCAGGGCAAATTGGT : 162
TrMDHb3  : TCAAAAATGGCCAAAGACCCAGTTCGTGTTCTCGTCACTGGTGCTGCAGGGCAAATTGGT : 154
TrMDHb4  : TCAGGAATGGCCAAAGACCCAGTTCGTGTGCTCGTTACTGGTGCTGCAGGGCAAATTGGT : 151
TrMDHb5  : TCAAAAATGGCCAAAGACCCAGTTCGTGTTCTCGTCACTGGTGCTGCAGGGCAAATTGGT : 151
TrMDHb6  : TCAGGAATGGCCAAAGACCCAGTTCGTGTGCTCGTTACTGGTGCTGCAGGGCAAATTGGT : 144
TrMDHb7  : TCAGGAATGGCCAAAGACCCAGTTCGTGTGCTCGTTACTGGTGCTGCAGGGCAAATTGGT : 145
TrMDHb8  : TCAGGAATGGCCAAAGACCCAGTTCGTGTGCTCGTTACTGGTGCTGCAGGGCAAATTGGT : 144
TrMDHb9  : TCAAAAATGGCCAAAGACCCAGTTCGTGTTCTCGTCACTGGTGCTGCAGGGCAAATTGGT : 132
TrMDHb10 : TCAAAAATGGCCNAAGACCCAGTTCGTGTTCTCGTCACTGGTGCTGCNGGGCAAATTGGT : 138
TrMDHb11 : TCAAAAATGGCCAAAGACCCAGTTCGTGTTCTCGTCACTGGTGCTGCAGGGCAAATTGGT : 140
TrMDHb12 : TCAAAAATGGCCAAAGACCCAGTTCGTGTTCTCGTCACTGGTGCTGCAGGGCAAATTGGT : 141
TrMDHb13 : TCAGGAATGGCCAAAGACCCAGTTCGTTTGCTCGTTACTGGTGCTGCAGGGCAAATTGGT : 135
TrMDHb14 : TCAAAAATGGCCAAANACCCAGTTCGTGTTCTCGTCACTGGTGCTGCAGGGCAAATTGGT : 131
TrMDHb15 : TCAAAAATGGCCAAAGACCCAGTTCGTGTTCTCGTCACTGGTGCTGCAGGGCAAATTGGT : 139
TrMDHb16 : TCAAAAATGGCCAAAGACCCAGTTCGTGTTCTCGTCACTGGTGCTGCAGGGCAAATTGGT : 138
TrMDHb17 : TCAAAAATGGCCAAAGACCCAGTTCGTGTTCTCGTCACTGGTGCTGCAGGGCAAATTGGT : 136
TrMDHb18 : TCAAAAATGGCCAAAGACCCAGTTCGTGTTCTCGTCACTGGTGCTGCAGGGCAAATTGGT : 134
TrMDHb19 : TCAAAAATGGCCAAAGACCCAGTTCGTGTTCTCGTCACTGGTGCTGCAGGGCAAATTGGT : 130
TrMDHb20 : TCAAAAATGGCCAAAGACCCAGTTCGTGTTCTCGTCACTGGTGCTGCAGGGCAAATTGGT : 123
TrMDHb21 : TCAAAAATGGCCAAAGACCCAGTTCGTGTTCTCGTCACTGGTGCTGCAGGGCAAATTGGT : 123
TrMDHb22 : TCAAAAATGGCCAAAGACCCAGTTCGTGTTCTCGTCACTGGTGCTGCAGGGCAAATTGGT : 119
TrMDHb23 : T-NAAAATGGCCAAAGACCCAGTTCGTGTTCTCGTCACTGGTGCTGCAGGGCAAATTGGT : 110
TrMDHb24 : TCAAAAATGGCCAAAGACCCAGTTCGTGTTCTCGTCACTGGTGCTGCAGGGCAAATTGGT : 109
TrMDHb25 : TCAAAAATGGCCAAAGACCCAGTTCGTGTTCTCGTCACTGGTGCTGCAGGGCAAATTGGT : 106
TrMDHb26 : T-NAAAATGGCCAAAGACCCAGTTCGTGTGCTCGTCACTGGTGCTGCAGGGCAAATTGGT : 103
TrMDHb27 : TC-AAAATGGCC-AAGACCCAGTTCGTGTTCTCGTCACTGGTGCTGCAGGGCAAATTGGT :  97
TrMDHb28 : ------------------------------------------------------------ :   -
TrMDHb29 : ------------------------------------------------------------ :   -
TrMDHb30 : ------------------------------------------------------------ :   -
TrMDHb31 : ------------------------------------------------------------ :   -
TrMDHb32 : ------------------------------------------------------------ :   -
```

FIGURE 10 (cont.)

```
TrMDHb1  : TATGCACTTGTCCCTATGATTGCTAGGGGAGTGATGCTTGGTCCTGATCAACCTGTGATC : 224
TrMDHb2  : TATGCACTTGTCCCTATGATTGCTAGGGGAGTGATGCTTGGTCCTGATCAACCTGTGATC : 222
TrMDHb3  : TATGCACTTGTCCCTATGATTGCTAGGGGAGTGATGCTTGGTCCTGATCAACCTGTGATC : 214
TrMDHb4  : TATGCACTTGTCCCTATGATTGCTAGGGGAGTGATGCTTGGTCCTGATCAACCTGTGATC : 211
TrMDHb5  : TATGCACTTGTCCCTATGATTGCTAGGGGAGTGATGCTTGGTCCTGATCAACCTGTGATC : 211
TrMDHb6  : TATGCACTTGTCCCTATGATTGCTAGGGGAGTGATGCTTGGTCCTGATCAACCTGTGATC : 204
TrMDHb7  : TATGCACTTGTCCCTATGATTGCTAGGGGAGTGATGCTTGGTCCTGATCAACCTGTGATC : 205
TrMDHb8  : TATGCACTTGTCCCTATGATTGCTAGGGGAGTGATGCTTGGTCCTGATCAACCTGTGATC : 204
TrMDHb9  : TATGCACTTGTCCCTATGATTGCTAGGGGAGTGATGCTTGGTCCTGATCAACCTGTGATC : 192
TrMDHb10 : TATGCACTTGTCCCTATGATTGCTAGGGGAGTGATGCTTGGTCCTGATCAACCTGTGATC : 198
TrMDHb11 : TATGCACTTGTCCCTATGATTGCTAGGGGAGTGATGCTTGGTCCTGATCAACCTGTGATC : 200
TrMDHb12 : TATGCACTTGTCCCTATGATTGCTAGGGGAGTGATGCTTGGTCCTGATCAACCTGTGATC : 201
TrMDHb13 : TATGCACTTGTCCCTATGATTGCTAGGGGAGTGATGCTTGGTCCTGATCAACCTGTGATC : 195
TrMDHb14 : TATGCACTTGTCCCTATGATTGCTAGGGGAGTGATGCTTGGTCCTGATCAACCTGTGATC : 191
TrMDHb15 : TATGCACTTGTCCCTATGATTGCTAGGGGAGTGATGCTTGGTCCTGATCAACCTGTGATC : 199
TrMDHb16 : TATGCACTTGTCCCTATGATTGCTAGGGGAGTGATGCTTGGTCCTGATCAACCTGTGATC : 198
TrMDHb17 : TATGCACTTGTCCCTATGATTGCTAGGGGAGTGATGCTTGGTCCTGATCAACCTGTGATC : 196
TrMDHb18 : TATGCACTTGTCCCTATGATTGCTAGGGGAGTGATGCTTGGTCCTGATCAACCTGTGATC : 194
TrMDHb19 : TATGCACTTGTCCCTATGATTGCTAGGGGAGTGATGCTTGGTCCTGATCAACCTGTGATC : 190
TrMDHb20 : TATGCACTTGTCCCTATGATTGCTAGGGGAGTGATGCTTGGTCCTGATCAACCTGTGATC : 183
TrMDHb21 : TATGCACTTGTCCCTATGATTGCTAGGGGAGTGATGCTTGGTCCTGATCAACCTGTGATC : 183
TrMDHb22 : TATGCACTTGTCCCTATGATTGCTAGGGGAGTGATGCTTGGTCCTGATCAACCTGTGATC : 179
TrMDHb23 : TATGCACTTGTCCCTATGATTGCTAGGGGAGTGATGCTTGGTCCTGATCAACCTGTGATC : 170
TrMDHb24 : TATGCACTTGTCCCTATGATTGCTAGGGGAGTGATGCTTGGTCCTGATCAACCTGTGATC : 169
TrMDHb25 : TATGCACTTGTCCCTATGATTGCTAGGGGAGTGATGCTTGGTCCTGATCAACCTGTGATC : 166
TrMDHb26 : TATNCACTTGTCCCTATGATTGCTAGGGGAGTGATGCTTGGTCCTGATCAACCTGTGATC : 163
TrMDHb27 : TATGCACTTGTCCCTATGATTGCTAGGGGAGTGATGCTTGGTCCTGATCAACCTGTGATC : 157
TrMDHb28 : ---------------------GGGGAGTGATGCTTGGTCCTGAT-NACCTGTGATC     :  34
TrMDHb29 : ------------------------------------------------------------ :   -
TrMDHb30 : ------------------------------------------------------------ :   -
TrMDHb31 : ------------------------------------------------------------ :   -
TrMDHb32 : ------------------------------------------------------------ :   -
```

FIGURE 10 (cont.)

```
                        *         260         *         280         *         300
TrMDHb1   : CTACACATGCTTGATATTCCACCGGCAGCAGAGTCATTGAATGGAGTTAAGATGGAGATG  : 284
TrMDHb2   : CTACACATGCTTGATATTCCACCGGCAGCAGAGTCATTGAATGGAGTTAAGATGGAGTTG  : 282
TrMDHb3   : CTTCACATGCTTGATATCCCTCCAGCAGCAGAGTCATTGAATGGAGTTAAAATGGAGTTG  : 274
TrMDHb4   : CTTCACATGCTTGATATCCCTCCAGCAGCAGAGTCATTGAATGGAGTTAAAATGGAGTTG  : 271
TrMDHb5   : CTTCACATGCTTGATATTCCTCCAGCAGCAGAGTCATTGAATGGAGTTAAGATGGAGTTG  : 271
TrMDHb6   : CTTCACATGCTTGATATCCCTCCAGCAGCAGAGNCATTGAATGGAGTTAAAATGGAGTTG  : 264
TrMDHb7   : CTTCACATGCTTGATATCCCTCCAGCAGCAGAGTCATTGAATGGAGTTAAAATGGAGTTG  : 265
TrMDHb8   : CTTCACATGCTTGATATCCCTCCAGCAGCAGAGTCATTGAATGGAGTTAAAATGGAGTTG  : 264
TrMDHb9   : CTTGACATGCTTGATATTGCTGCAGNAGNAGAGTNATTGAATGGAGCTAAAATGGAGCTG  : 252
TrMDHb10  : CTACACATGCTTGATATTCCACCGGCAGCAGAGTCATTGAATGGAGTTAAGATGGAGTTC  : 258
TrMDHb11  : CTTCACATGCTTGATATTCCTCCAGCAGCAGAGTCATTGAATGGAGTTAAGATGGAGTTG  : 260
TrMDHb12  : CTACACATGCTTGATATTCCACCGGCAGCAGAGTCATTGAATGGAGTTAAGATGGAGTTG  : 261
TrMDHb13  : CTTCACATGCTTGATATCCCTCCAGCAGCAGAGTCATTGAATGGAGTTAAAATGGAGTTG  : 255
TrMDHb14  : CTTCACATGCTTGATATTCCTCCAGCAGCAGAGTCATTGAATGGAGTTAAAATGGAGTTG  : 251
TrMDHb15  : CTACACATGCTTGATATTCCACCGGCAGCAGAGTCATTGAATGGAGTTAAGATGGAGTTG  : 259
TrMDHb16  : CTACACATGCTTGATATTCCACCGGCAGCAGAGTCATTGAATGGAGTTAAGATGGAGTTG  : 258
TrMDHb17  : CTTCACATGCTTGATATTCCTCCAGCAGCAGAGTCATTGAATGGAGTTAAAATGGAGTTG  : 256
TrMDHb18  : CTTCACATGCTTGATATTCCTCCAGCAGCAGAGTCATTGAATGGAGTTAAGATGGAGTTG  : 254
TrMDHb19  : CTTCACATGCTTGATATTCCTCCAGCAGCAGAGTCATTGAATGGAGTTAAAATGGAGTTC  : 250
TrMDHb20  : CTTCACATGCTTGATATTCCTCCAGCAGCAGAGTCATTGAATGGAGTTAAAATGGAGTTG  : 243
TrMDHb21  : CTTCACATGCTTGATATTCCTCCAGCAGCAGAGTCATTGAATGGAGTTAAGATGGAGTTG  : 243
TrMDHb22  : CTTCACATGCTTGATATTCCTCCAGCAGCAGAGTCATTGAATGGAGTTAAAATGGAGTTG  : 239
TrMDHb23  : CTACACATGCTTGATATTCCACCGGCAGCAGAGTCATTGAATGGAGTTAAGATGGAGTTG  : 230
TrMDHb24  : CTACACATGCTTGATATTCCACCGGCAGCAGAGTCATTGAATGGAGTTAAGATGGAGTTG  : 229
TrMDHb25  : CTTCACATGCTTGATATTCCTACAGCAGCAGAGTCATTGAATGGAGTTAAGATGGAGTTG  : 226
TrMDHb26  : CTTCACATGCTTGATATTCCTCCAGCAGCAGAGTCATTGAATGGAGTTAAAATGGAGTTG  : 223
TrMDHb27  : CTTCACATGCTTGATATTCTTCCAGCAGCAGAGTCATTGAATGGAGTTAAGATGGAGTTG  : 217
TrMDHb28  : CTT-NCATGCTTGATATCCCTCCAGCAGCAGAGTCATTGAATGGAGTTAAAATGGAGTTG  :  93
TrMDHb29  : --------------NTATTCCTNCNGCAGCNGAGT-NTTGAATGGAG-TAAGATGGAGTTG :  45
TrMDHb30  : --------------TATTCCT-CCGCAGCAGAGT-NTTGAATGGAG-TAAGATGGAGTTG :  43
TrMDHb31  : ------------------------------------------------------------  :   -
TrMDHb32  : ------------------------------------------------------------  :   -
```

FIGURE 10 (cont.)

```
                *         320         *         340         *         360
TrMDHb1  : GNCGATGCTGNATTNNCACTTGTTAAAGGNGANGCTGCT------------------- : 323
TrMDHb2  : GTCGATGCTGCATTTCCACTTGTTAAAGGTGNTCATCNTACAACTGATGATGCNGACGNA : 342
TrMDHb3  : GTCGATGCTGCATTTCCACTTCTTAAAGGTGTTGTTGCTACAACTGATGTTGTTGAAGCA : 334
TrMDHb4  : GTGGATGCTGCATTTCCACTTCTTAAAGGCGTTGTTGCTACAACTGATGTTGTTGAAGCA : 331
TrMDHb5  : GTCGATGCTGCATTTCCACTTCTTAAAGGTGTTGTTGCTACAACTGATGTTGTTGAGGCA : 331
TrMDHb6  : GTCGATGCTGCATTTCCACTTCTTAAAGCGTTGTTGCTACAACTGATGTTGTTGAAGCA  : 324
TrMDHb7  : GCCGATGCTGCATTTCCACTTCTTAAAGGCGTTGTTGCTACAACTGATGTTGTTGAAGCA : 325
TrMDHb8  : GTCGATGCTGCATTTCCACTTCTTAAAGGCGTTGTTGCTACAACTGATGTTGTTGAAGCA : 324
TrMDHb9  : CCGGATGCTGNATTNNAACTTCTTACAGGCGCCGCCGCTACCACTGATGCTGCCCAACCA : 312
TrMDHb10 : GTCGATGCTGCATTTCCACTTCTTAAAGGTGTTGTTGCTACAACTGATGTTGTTGAGGCA : 318
TrMDHb11 : GTCGATGCTGCATTTCCACTTCTTAAAGGTGTTGTTGCTACAACTGATGTTGTTGACGCA : 320
TrMDHb12 : GTCGATGCTGCATTTCCACTTCTTAAAGGTGTTGTTGCTACAACTGATGTTGTTGACGCA : 321
TrMDHb13 : GTGGATGCTGCATTTCCACTTCTTAAAGGCGTTGTTGCTACAACTGATGTTGTTGAAGCA : 315
TrMDHb14 : GTCGATGCTGCATTTCCACTTCTTAAAGGTGTTGTTGCTACAACTGATGTTGTTGAAGCA : 311
TrMDHb15 : GTCGATGCTGCATTTCCACTTCTTAAAGGTGTTGTTGCTACAACTGATGTTGTTGACGCA : 319
TrMDHb16 : GTCGATGCTGCATTTCCACTTCTTAAAGGTGTTGTTGCTACAACTGATGTTGTTGAGGCA : 318
TrMDHb17 : GTCGATGCTGCATTTCCACTTCTTAAAGGTGTTGTTGCTACAACTGATGTTGTTGAAGCA : 316
TrMDHb18 : GTCGATGCTGCATTTCCACTTCTTAAAGGTGTTGTTGCTACAACTGATGTTGTTGAGGCA : 314
TrMDHb19 : GTCGATGCTGCATTTCCACTTCTTAAAGGTGTTGTTGCTACAACTGATGTTGTTGAAGCA : 310
TrMDHb20 : GTCGATGCTGCATTTCCACTTCTTAAAGGTGTTGTTGCTACAACTGATGTTGTTGAAGCA : 303
TrMDHb21 : GTCGATGCTGCATTTCCACTTCTTAAAGGTGTTGTTGCTACAACTGATGTTGTTGAGGCA : 303
TrMDHb22 : GTCGATGCTGCATTTCCACTTCTTAAAGGTGTTGTTGCTACAACTGATGTTGTTGAAGCA : 299
TrMDHb23 : GTCGATGCTGCATTTCCACTTCTTAAAGGTGTTGTTGCTACAACTGATGTTGTTGACGCA : 290
TrMDHb24 : GTCGATGCTGCATTTCCACTTCTTAAAGGTGTTGTTGCTACAACTGATGTTGTTGACGCA : 289
TrMDHb25 : GTCGATGCTGCATTTCCACTTCTTAAAGGTGTTGTTGCTACAACTGATGTTGTTGAGGCA : 286
TrMDHb26 : GTCGATGCTGCATTTCCACTTCTTAAAGGTGTTGTTGCTACAACTGATGTTGTTGAAGCA : 283
TrMDHb27 : GTCGATGCTGCATTTCCACTTCTTAAAGGTGTTGTTGCTACAACTGATGTTGTTGAGGCA : 277
TrMDHb28 : GTCGATGCTGCATTTCCACTTCTTAAAGCATTGTTGCTACAACTGATGTTGTTGAAGCA  : 153
TrMDHb29 : GTCGATGCTGCATTTCCACTTCTTAAAGGTGTTGTTGCTACAACTGATGTTGTTGAGGCA : 105
TrMDHb30 : GTCGATGCTGCATTTCC-CTTCTTAAAGGTGTTGTTGCTACAACTGATGTTGTTGAGGCA : 102
TrMDHb31 : ------------------------------------------------------------ :   -
TrMDHb32 : ------------------------------------------------------------ :   -
```

FIGURE 10 (cont.)

```
                       *         380         *         400         *         420
TrMDHb1  : ------------------------------------------------------------ :   -
TrMDHb2  : TNNNCTGG---------------------------------------------------- : 350
TrMDHb3  : TGCACTGGAGTCAATATTGCAGTCATGGTTGGTGGATTCCCAAGAAAAGAAGGTATGGAG : 394
TrMDHb4  : TGCACTGGAGTCAATATTGCAGTCATGGTTGGTGGATTCCCAAGAAAAGAAGGTATGGAG : 391
TrMDHb5  : TGCACTGGAGTCAATATTGCAGTCATGGTTGGTGGATTCCCAAGAAAAGAAGGTATGGAG : 391
TrMDHb6  : TGCACTGGAGTCAATATTGCAGTCATGGTTGGTGGATTCCCAAGAAAAGAAGGTATGGAG : 384
TrMDHb7  : TGCACTGGAGTCAATATTGCAGTCATGGTTGGTGGATTCCCAAGAAAAGAAGGTATGGAG : 385
TrMDHb8  : TGCACTGGAGTCAATATTGCAGTCATGGTTGGTGGATTCCCAAGAAAAGAAGGTATGGAG : 384
TrMDHb9  : TGCACTGCA-CCGATATNCCNN--------------------------------------- : 333
TrMDHb10 : TGCACTGGAGTCAATATGGCAGTCATGGTTGGTGGATTCCCAAGAAAAGAAGGTATGGAN : 378
TrMDHb11 : TGCACTGGAGTCAATATTGCAGTCATGGTTGGTGGATTCCCAAGAAAAGAAGGTATGGAG : 380
TrMDHb12 : TGCACTGGAGTCAATATGGCAGTCATGGTTGGTGGATTCCCAAGAAAAGAAGGTATGGAG : 381
TrMDHb13 : TGCACTGGAGTCAATATTGCAGTCATGGTTGGTGGATTCCCAAGAAAAGAAGGTATGGAG : 375
TrMDHb14 : TGCACTGGAGTCAATATTGCAGTCATGGTTGGTGGATTCCCAAGAAAAGAAGGTATGGAG : 371
TrMDHb15 : TGCACTGGAGTCAATATGGCAGTCATGGTTGGTGGATTCCCAAGAAAAGAAGGTATGGAG : 379
TrMDHb16 : TGCACTGGAGTCAATATGGCAGTCATGGTTGGTGGATTCCCAAGAAAAGAAGGTATGGAG : 378
TrMDHb17 : TGCACTGGAGTCAATATTGCAGTCATGGTTGGTGGATTCCCAAGAAAAGAAGGTATGGAG : 376
TrMDHb18 : TGCACTGGAGTCAATATTGCAGTCATGGTTGGTGGATTCCCAAGAAAAGAAGGTATGGAG : 374
TrMDHb19 : TGCACTGGAGTCAATATTGCAGTCATGGTTGGTGGATTCCCAAGAAAAGAAGGTATGGAG : 370
TrMDHb20 : TGCACTGGAGTCAATATTGCAGTCATGGTTGGTGGATTCCCAAGAAAAGAAGGTNTGGAG : 363
TrMDHb21 : TGCACTGGAGTCAATATTGCAGTCATGGTTGGTGGATTCCCAAGAAAAGAAGGTATGGAG : 363
TrMDHb22 : TGCACTGGAGTCAATATTGCAGTCATGGTTGGTGGATTCCCAAGAAAAGAAGGTATGGAG : 359
TrMDHb23 : TGCACTGGAGTCAATATGGCAGTCATGGTTGGTGGATTCCCAAGAAAAGAAGGTATGGAG : 350
TrMDHb24 : TGCACTGGAGTCAATATGGCAGTCATGGTTGGTGGATTCCCAAGAAAAGAAGGTATGGAG : 349
TrMDHb25 : TGCACTGGAGTCAATATTGCAGTCATGGTTGGTGGATTCCCAAGAAAAGAAGGTATGGAG : 346
TrMDHb26 : TGCACTGGAGTCAATATTGCAGTCATGGTTGGTGGATTCCCAAGAAAAGAAGGTATGGAG : 343
TrMDHb27 : TGCACTGGAGTCAATATTGCAGTCATGGTTGGTGGATTCCCAAGAAAAGAAGGTATGGAG : 337
TrMDHb28 : TGCACTGGAGTCAATATTGCAGTCATGGTTGGTGGATTCCCAAGAAAAGAAGGTATGGAG : 213
TrMDHb29 : TGCACTGGAGTCAATATTGCAGTCATGGTTGGTGGATTCCCAAGAAAAGAAGGTATGGAG : 165
TrMDHb30 : TGCACTGGAGTCAATATTGCAGTCATGGTTGGTGGATTCCCAAGAAAAGAAGGTATGGAG : 162
TrMDHb31 : --------------------------------------------------------GGAG :   4
TrMDHb32 : --------------------------------------------------------NNNN :   4
```

FIGURE 10 (cont.)

```
                          *         440         *         460         *         480
TrMDHb1   : ------------------------------------------------------------ :   -
TrMDHb2   : ------------------------------------------------------------ :   -
TrMDHb3   : AGGAAGGATGTGATGACTAAGAATGTCTCTATTTACAAGTCCCAGGCTTCTGCCCTTGAA : 454
TrMDHb4   : AGGAAGGATGTGATGACTAAGAATGTCTCTATTTACAAGTCCCAGGCTTCTGCCCTTGAA : 451
TrMDHb5   : AGGAAGGATGTGATGTCTAAGAACGTCTCTATTTACAAGTCCCAGGCTTCTGCCCTTGAA : 451
TrMDHb6   : AGGAAGGATGTGATGACTAAGAATGTCTCTATTTACAAGTCCCAGGCTTCTGCCCTTGAA : 444
TrMDHb7   : AGGAAGGATGTGATGACTAAGAATGTCTCTATTTACAAGTCCCAGGCTTCAGCCCTTGAA : 445
TrMDHb8   : AGGAAGGATGTGATGACTAAGAATGTCTCTATTTACAAGTCCCAGGCTTCTGCCCTTGAA : 444
TrMDHb9   : ------------------------------------------------------------ :   -
TrMDHb10  : AGGAAGGATGTTATGTCTAAGAACGTCTCTATTTACAAGTCCCAAGCTTCTGCCCTTGAA : 438
TrMDHb11  : AGGAAGGATGTGATGTCTAAGAACGTCTCTATTTACAAGTCCCAGGCTTCTGCCCTTGAA : 440
TrMDHb12  : AGGAAGGATGTTATGTCTAAGAACGTCTCTATTTACAAGTCCCAAGCTTCTGCCCTTGAA : 441
TrMDHb13  : AGGAAGGATGTGATGACTAAGAATGTCTCTATTTACAAGTCCCAGGCTTCTGCCCTTGAA : 435
TrMDHb14  : AGGAAGGATGTGATGACTAANAATGTCTCTATTTACAAGTCCCAGGCTTCTGCCCTTGAA : 431
TrMDHb15  : AGGAAGGATGTTATGTCTAAGAACGTCTCTATTTACAAGTCCCAGGCTTCTGCCCTTGAA : 439
TrMDHb16  : AGGAAGGATGTTATGTCTAAGAACGTCTCTATTTACAAGTCCCAAGCTTCTGCCCTTGAA : 438
TrMDHb17  : ACCAACCATGTCATCACTAACAATGTCTCTATTTACAAGTCCCAGGCTTCTGCCCTTGAA : 436
TrMDHb18  : AGGAAGGATGTGATGTCTAAGAACGTCTCTATTTACAAGTCCCAGGCTTCTGCCCTTGAA : 434
TrMDHb19  : AGGAAGGATGTGATGACTAAGAATGTCTCTATTTACAAGTCCCAGGCTTCTGCCCTTGAA : 430
TrMDHb20  : AGGAAGGATGTGATGACTAAGANTGTCTCTATTTACAANANNNAGNCTTNTGNCCTTGAA : 423
TrMDHb21  : AGGAAGGATGTGATGTCTAAGAACGTCTCTATTTACAAGTCCCAGGCTTCTGCCCTTGAA : 423
TrMDHb22  : AGGAAGGATGTGATGACTAAGAATGTCTCTATTTACAAGTCCCAGGCTTCTGCCCTTGAA : 419
TrMDHb23  : AGGAAGGATGTTATGTCTAAGAACGTCTCTATTTACAAGTCCCAGGCTTCTGCCCTTGAA : 410
TrMDHb24  : AGGAAGGATGTTATGTCTAAGAACGTCTCTATTTACAAGTCCCAAGCTTCTGCCCTTGAA : 409
TrMDHb25  : AGGAAGGATGTGATGTCTAAGAACGTCTCTATTTACAAGTCCCAGGCTTCTGCCCTTGAA : 406
TrMDHb26  : AGGAAGGATGTGATGACTAAGAATGTCTCTATTTACAAGTCCCAGGCTTCTGCCCTTGAA : 403
TrMDHb27  : AGGAAGGATGTGATGTCTAAGAACGTCTCTATTTACAAGTCCCAGGCTTCTGCCCTTGAA : 397
TrMDHb28  : AGGAAGGATGTGATGACTAAGAATGTCTCTATTTACAAGTCCCAGGCTTCTGCCCTTGAA : 273
TrMDHb29  : AGGAAGGATGTGATGTCTAAGAACGTCTCTATTTACAAGTCCCAGGCTTCTGCCCTTGAA : 225
TrMDHb30  : AGGAAGGATGTGATGTCTAAGAACGTCTCTATTTACAAGTCCCAGGCTTCTGCCCTTGAA : 222
TrMDHb31  : AGGAAGGATGTGATGTCTAAGAACGTCTCTATTTACAAGTCCCAGGCTTCTGCCCTTGAA :  64
TrMDHb32  : NNGNANGNNGTGATGTCTAANAACGTCTCTATTTACAAGTCCCAGGCTTCTGCCCTTGAA :  64
```

FIGURE 10 (cont.)

```
              *        500         *        520         *        540
TrMDHb1  : ------------------------------------------------------- : -
TrMDHb2  : ------------------------------------------------------- : -
TrMDHb3  : AAGCATGCTGCTGCCAACTGCAAGGTTTTGGTTATTGCTAACCCAGCAAATACCAATGCA : 514
TrMDHb4  : AAGCATGCTGCTGCCAACTGCAAGGTTTTGGTTATTGCTAACCCAGCAAATACCAATGCA : 511
TrMDHb5  : AAGCATGCTGCTGCCAACTGCAAGGNTTTGGTTGNTGCTAACCCANC-AACACCAATGCA : 510
TrMDHb6  : AAGCATGCTGCTGCCAACTGCAAGGTTTTGGTTATTGCTAACCCAGCAAATACCAATGCA : 504
TrMDHb7  : AAGCATGCTGCTGCCAACTGCAAGGTTTTGGTTATTGCTAACCCAGCAAATACCAATGCA : 505
TrMDHb8  : AAGCATGCTGCTGCCAACTGCAAGGTTTTGGTTATTGCTAACCCAGCAAATACCAATGCA : 504
TrMDHb9  : ------------------------------------------------------- : -
TrMDHb10 : AAGCATGCTGCTGCCAACTGCAAGGTTTTGGTTGTTGCTAACCCAGCAAACACCAATGCA : 498
TrMDHb11 : AAGCATGCTGCTGCCAACTGCAAGGTTTTGGTTGTTGCTAACCCAGC-AACACCAATGCA : 499
TrMDHb12 : AAGCATGCTGCTGCCAACTGCAAGGTTTTGGTTGTTGCTAACCCAGCAAACACCAATGCA : 501
TrMDHb13 : AAGCATGCTGCTGCCAACTGCAAGGTTTTGGTTATTGCTAACCCAGCAAATACCAATGCA : 495
TrMDHb14 : AAGCATGCTGCTGCCAACTGCAAGGTTTTGG----------------------------- : 462
TrMDHb15 : AAGCATGCTGCTGCCAACTGCAAGGTTTTGGTTGTTGCTAACCCAGCAAACACCAATGCA : 499
TrMDHb16 : AAGCATGCTGCTGCCAACTGCAAGGTTTTGGTTGTTGCTAACCCAGCAAACACCAATGCA : 498
TrMDHb17 : AAGCATGCTGCTGCCAACTGCAAGGNTTTGGGTATTGCTAACCCANCAAATACCAATGCA : 496
TrMDHb18 : AAGCATGCTGCTGCCAACTGCAAGGTTTTGGTTGTTGCTAACCCAGC-AACACCAATGCA : 493
TrMDHb19 : AAGCATGCTGCTGCCAACTGCAAGGTTTTGGTTATTGCTAACCCAGCAAATACCAATGCA : 490
TrMDHb20 : AANGATNCTG-------------------------------------------------- : 433
TrMDHb21 : AAGCATGCTGCTGCCAACTGCAAGGTTTTGGTTGTTGCTAACCCAGCAAACACCAATGCA : 483
TrMDHb22 : AAGCATGCTGCTGCCAACTGCAAGGTTTTGGTTATTGCTAACCCAGCAAATACCAATGCA : 479
TrMDHb23 : AAGCATGCTGCTGCCAACTGCAAGGTTTTGGTTGTTGCTAACCCAGCAAACACCAATGCA : 470
TrMDHb24 : AAGCATGCTGCTGCCAACTGCAAGGTTTTGGTTGTTGCTAACCCAGCAAACACCAATGCA : 469
TrMDHb25 : AAGCATGCTGCTGCCAACTGCAAGGTTTTGGTTGTTGCTAACCCAGCAAACACCAATGCA : 466
TrMDHb26 : AAGCATGCTGCTGCCAACTGCAAGGTTTTGGTTATTGCTAACCCAGCAAATACCAATGCA : 463
TrMDHb27 : AAGCATGCTGCTGCCAACTGCAAGGTTTTGGTTGTTGCTAACCCAGCAAACACCAATGCA : 457
TrMDHb28 : AAGCANGCTGCTGCCAACTGCAAGGTTTTGGTTATTGCTAACCCAGCAAATACCAATGCA : 333
TrMDHb29 : AAGCATGCTGCTGCCAACTGCAAGGTTTTGGTTGTTGCTAACCCAGCAAACACCAATGCA : 285
TrMDHb30 : AAGCATGCTGCTGCCAACTGCAAGGTTTTGGTTGTTGCTAACCCAGCAAACACCAATGCA : 282
TrMDHb31 : AAGCATGCTGCTGCCAACTGCAAGGTTTTGGTTGTTGCTAACCCAGCAAACACCAATGCA : 124
TrMDHb32 : AAGCATGCTGCTGCCAACTGCAAGGTTTTGGTTGTTGCTAACCCAGCAAACACCAATGCA : 124
```

FIGURE 10 (cont.)

```
                         *         560         *         580         *         600
TrMDHb1  : ------------------------------------------------------------ :   -
TrMDHb2  : ------------------------------------------------------------ :   -
TrMDHb3  : TTGATCTTGAAGGAGTTTGCTCCATCTATTCCAGAGAAAAACATTTCAGCTTTGACTAGA : 574
TrMDHb4  : TTGATCTTGAAGGAGTTTGCTCCATCTATTCCAGAGAAAAACATTTCAGCTTTGACTAGA : 571
TrMDHb5  : TTGATCTTGNAGGAATCNGCT--------------------------------------- : 531
TrMDHb6  : TTGATCTTGAAGGAGTTTGCTCCATCTATTCCAGAGAAAAACATTTCAGCTTTGACTAGA : 564
TrMDHb7  : TTGATCTTGAAGGAGTTTGCTCCATCTATTCCAGAGAAAAACATTTCAGCTTTGACTAGA : 565
TrMDHb8  : TTGATCTTGAAGGAGTTTGCTCCATCTATTCCAGAGAAAAACATTTCAGCTTTGACTAGA : 564
TrMDHb9  : ------------------------------------------------------------ :   -
TrMDHb10 : TTGATCTTGAAGGAATTTGCTCCATCTATTCCAGAGAAAAACATTTCTTGTTNGACTAGA : 558
TrMDHb11 : TTGATCTTGAAGGAATTTGCTCCATCTATTCCAGAGAAAAACATTTCTTGTTTGACTAGA : 559
TrMDHb12 : TTGATCTTGAAGGAATTTGCTCCATCTATTCCAGAGAAAAACATTTCTTGTTTGACTAGA : 561
TrMDHb13 : TTGATCTTGAAGGAGTTTGCTCCATCTATTCCAGAGAAAAACATTTCAGCTTTGACTAGA : 555
TrMDHb14 : ------------------------------------------------------------ :   -
TrMDHb15 : TTGATCTTGAAGGAATTTGCTCCATCTATTCCAGAGAAAAACATTTCTTGTTTGACTAGA : 559
TrMDHb16 : TTGATCTTGAAGGAATTTGCTCCATCTATTCCAGAGAAAAACATTTCTTGTTTGACTAGA : 558
TrMDHb17 : TTGATCTTGAAGGAGTTTGCTCCATCTATTCCAGANAAAAACATTTCANCTTTG------ : 550
TrMDHb18 : TTGATCTTGAAGGAATTTGCTCCATCTATTCCAGAGAAAAACATTTCTTGTTTGACTAGA : 553
TrMDHb19 : TTGATCTTGAAGGAGTTTGCTCCATCTATTCCAGAGAAAAACATTTCAGCTTTGACTAGA : 550
TrMDHb20 : ------------------------------------------------------------ :   -
TrMDHb21 : TTGATCTTGAAGGAATTTGCTCCATCTATTCCAGAGAAAAACATTTCTTGTTTGACTAGA : 543
TrMDHb22 : TTGATCTTGAAGGAGTTTGCTCCATCTATTCCAGAGAAAAACATTTCAGCTTTGACTAGA : 539
TrMDHb23 : TTGATCTTGAAGGAATTTGCTCCATCTATTCCAGAGAAAAACATTTCTTGTTTGACTAGA : 530
TrMDHb24 : TTGATCTTGAAGGAATTTGCTCCATCTATTCCAGAGAAAAACATTTCTTGTTTGACTAGA : 529
TrMDHb25 : TTGATCTTGAAGGAATTTGCTCCATCTATTCCAGAGAAAAACATTTCTTGTTTGACTAGA : 526
TrMDHb26 : TTGATCTTGAAGGAGTTTGCTCCATCTATTCCAGAGAAAAACATTTCAGCTTTGACTAGA : 523
TrMDHb27 : TTGATCTTGAAGGAATTTGCTCCATCTATTCCAGAGAAAAACATTTCTTGTTTGACTAGA : 517
TrMDHb28 : TTGATCTTGAAGGAGTTTGCTCCATCTATTCCAGAGAAAAACATTTCAGCTTTGACTAGA : 393
TrMDHb29 : TTGATCTTGAAGGAATTTGCTCCATCTATTCCAGAGAAAAACATTTCTTGTTTGACTAGA : 345
TrMDHb30 : TTGATCTTGAAGGAATTTGCTCCATCTATTCCAGAGAAAAACATTTCTTGTTTGACTAGA : 342
TrMDHb31 : TTGATCTTGAAGGAATTTGCTCCATCTATTCCAGAGAAAAACATTTCTTGTTTGACTAGA : 184
TrMDHb32 : TTGATCTTGAAGGAATTTGCTCCATCTATTCCAGAGAAAAACATTTCTTGTTTGACTAGA : 184
```

FIGURE 10 (cont.)

```
              *         620         *         640         *         660
TrMDHb1  : ---------------------------------------------------------------- :   -
TrMDHb2  : ---------------------------------------------------------------- :   -
TrMDHb3  : CTTGATCACAA----------------------------------------------------- : 585
TrMDHb4  : CTTGATCACAACAGGGCATTGG------------------------------------------- : 593
TrMDHb5  : ---------------------------------------------------------------- :   -
TrMDHb6  : CTTGATCAC------------------------------------------------------- : 573
TrMDHb7  : CTTGATCACAACAGGGCATTGGGCCAAATTTCTGAAAG--------------------------- : 603
TrMDHb8  : CTTGATCACAACAGGGCATTGGGCCAAATTTCT-------------------------------- : 597
TrMDHb9  : ---------------------------------------------------------------- :   -
TrMDHb10 : CTTGATCAC------------------------------------------------------- : 567
TrMDHb11 : CTTGATCAC------------------------------------------------------- : 569
TrMDHb12 : CTTGATCACAACAGGGCATTGGGCCAAATTT---------------------------------- : 592
TrMDHb13 : CTTGATCACAACAGGGCATTGGGCCAAATT----------------------------------- : 585
TrMDHb14 : ---------------------------------------------------------------- :   -
TrMDHb15 : CTTGATCACAACAG--------------------------------------------------- : 573
TrMDHb16 : CTTGATCACAACAGGGCATTGGGCCAAATTTCTGAAAGATTGAAT-------------------- : 603
TrMDHb17 : ---------------------------------------------------------------- :   -
TrMDHb18 : CTTGATCACAACAGGGCATTGGGCCAAATTTCTGAAAG--------------------------- : 591
TrMDHb19 : CTTGATCACAACAGGGCATTG-------------------------------------------- : 571
TrMDHb20 : ---------------------------------------------------------------- :   -
TrMDHb21 : CTTGATCACAACAGGGCATTGGGCCAAATTTCTGAAAGATTG----------------------- : 585
TrMDHb22 : CTTGATCACAACAGGGCATTGGGCCAAATTTCTGAAAGATTGAATATTCAAGTTTCTGAT      : 599
TrMDHb23 : CTTGATCACAACAGGGCATTGGGCCAAATTTCTGAAAG--------------------------- : 568
TrMDHb24 : CTTGATCACAACAGGGCATTGGGCCAAAT------------------------------------ : 558
TrMDHb25 : CTTGATCACAACAGGGCATTGGGCCAAATTTCTGAAAGATTGAATGTTCAAGTTTCTGAT      : 586
TrMDHb26 : CTTGATCACAACAGGGCATTGGGCCAAATTTCTGAAAGATTGAATATTCAAGTTTCTGAT      : 583
TrMDHb27 : CTTGATCACAACAGGGCATTGGGCCAAATTTCTGAAAGATTGAATGTTCAAGTTTC----      : 573
TrMDHb28 : CTTGATCACAACAGGGCATTGGGCCAAATTTCTGAAAGATTGAATATTCAAGTTTCTGAT      : 453
TrMDHb29 : CTTGATCACAACAGGGCATTGNGCCAAATTTCTGAAAGATTGAATGTCCAAGTTTCTGAT      : 405
TrMDHb30 : CTTGATCACAACAGGGCATTGGGCCAAATTTCTGAAAGATTGAATGTCCAAGTTTCTGAT      : 402
TrMDHb31 : CTTGATCACAACAGGGCATTGGGCCAAATTTCTGAAAGATTGAATGTTCAAGTTTCTGAT      : 244
TrMDHb32 : CTTGATCACAACAGGGCATTGGGCCAAATTTCTGAAAGATTGAATGTTCAAGTTTCTGAT      : 244
```

FIGURE 10 (cont.)

```
                             *       680         *       700         *       720
TrMDHb1   : ------------------------------------------------------------- :   -
TrMDHb2   : ------------------------------------------------------------- :   -
TrMDHb3   : ------------------------------------------------------------- :   -
TrMDHb4   : ------------------------------------------------------------- :   -
TrMDHb5   : ------------------------------------------------------------- :   -
TrMDHb6   : ------------------------------------------------------------- :   -
TrMDHb7   : ------------------------------------------------------------- :   -
TrMDHb8   : ------------------------------------------------------------- :   -
TrMDHb9   : ------------------------------------------------------------- :   -
TrMDHb10  : ------------------------------------------------------------- :   -
TrMDHb11  : ------------------------------------------------------------- :   -
TrMDHb12  : ------------------------------------------------------------- :   -
TrMDHb13  : ------------------------------------------------------------- :   -
TrMDHb14  : ------------------------------------------------------------- :   -
TrMDHb15  : ------------------------------------------------------------- :   -
TrMDHb16  : ------------------------------------------------------------- :   -
TrMDHb17  : ------------------------------------------------------------- :   -
TrMDHb18  : ------------------------------------------------------------- :   -
TrMDHb19  : ------------------------------------------------------------- :   -
TrMDHb20  : ------------------------------------------------------------- :   -
TrMDHb21  : ------------------------------------------------------------- :   -
TrMDHb22  : GTAAAGAATGT-------------------------------------------------- : 610
TrMDHb23  : ------------------------------------------------------------- :   -
TrMDHb24  : ------------------------------------------------------------- :   -
TrMDHb25  : GTAAAGAATGTCATTATCTGGGGTAATCATTCATCAACTCAGTATCCTGATGTCAACCAT : 646
TrMDHb26  : ------------------------------------------------------------- :   -
TrMDHb27  : ------------------------------------------------------------- :   -
TrMDHb28  : GTAAAGAATGTCATTATCTGGGGTAATCATTCATCAACTCAGTATCCTGATGTCAACCAT : 513
TrMDHb29  : GTAAAGAATGTCATTATCTGGNGTAATCATTCATCAACTCAGNATCCTGATGTCAACCAT : 465
TrMDHb30  : GTAAAGAATGTCATTATCTGGGGTAATCATTCATCAACTCAGTATCCTGATGTCAACCAT : 462
TrMDHb31  : GTAAAGAATGTCATTATCTGGGGTAATCATTCATCAACTCAGTATCCTGATGTCAACCAT : 304
TrMDHb32  : GTAAAGAATGTCATTATCTGGGGTAATCATTCATCAACTCAGTATCCTGATGTCAACCAT : 304
```

FIGURE 10 (cont.)

```
              *         740         *         760         *         780
TrMDHb1  : ------------------------------------------------------------ :   -
TrMDHb2  : ------------------------------------------------------------ :   -
TrMDHb3  : ------------------------------------------------------------ :   -
TrMDHb4  : ------------------------------------------------------------ :   -
TrMDHb5  : ------------------------------------------------------------ :   -
TrMDHb6  : ------------------------------------------------------------ :   -
TrMDHb7  : ------------------------------------------------------------ :   -
TrMDHb8  : ------------------------------------------------------------ :   -
TrMDHb9  : ------------------------------------------------------------ :   -
TrMDHb10 : ------------------------------------------------------------ :   -
TrMDHb11 : ------------------------------------------------------------ :   -
TrMDHb12 : ------------------------------------------------------------ :   -
TrMDHb13 : ------------------------------------------------------------ :   -
TrMDHb14 : ------------------------------------------------------------ :   -
TrMDHb15 : ------------------------------------------------------------ :   -
TrMDHb16 : ------------------------------------------------------------ :   -
TrMDHb17 : ------------------------------------------------------------ :   -
TrMDHb18 : ------------------------------------------------------------ :   -
TrMDHb19 : ------------------------------------------------------------ :   -
TrMDHb20 : ------------------------------------------------------------ :   -
TrMDHb21 : ------------------------------------------------------------ :   -
TrMDHb22 : ------------------------------------------------------------ :   -
TrMDHb23 : ------------------------------------------------------------ :   -
TrMDHb24 : ------------------------------------------------------------ :   -
TrMDHb25 : GCAACTGTTAACACCCCCGCTGGGGAGAAGCCTGTCCGTGAGCTTGTTTCTGATGACGCC : 706
TrMDHb26 : ------------------------------------------------------------ :   -
TrMDHb27 : ------------------------------------------------------------ :   -
TrMDHb28 : GCAACTGTTAACACCCCCGCCGGGGAGAAGCCTGTCCGTGAACTTGTTT----------- : 562
TrMDHb29 : GCAACTGTTAACACCCNCGCTGNNGAGAAGCCTGNCCGTGAGCTNGTTTC---------- : 515
TrMDHb30 : GCAACTGTTAACACCCCCGCTGGGGAGAAGCCTGTCCGTGAGCTTGTTTCTGATGACGCC : 522
TrMDHb31 : GCAACTGTTAACACCCCCGCTGGGGAGAAGCCTGTCCGTGAGCTTGTTTCTGATGACGCC : 364
TrMDHb32 : GCAACTGTTAACACCCCCGCTGGGGAGAAGCCTGTCCGTGAGCTTGTTTCTGATGACGCC : 364
```

FIGURE 10 (cont.)

```
              *       800       *       820       *       840
TrMDHb1   : ------------------------------------------------------ : -
TrMDHb2   : ------------------------------------------------------ : -
TrMDHb3   : ------------------------------------------------------ : -
TrMDHb4   : ------------------------------------------------------ : -
TrMDHb5   : ------------------------------------------------------ : -
TrMDHb6   : ------------------------------------------------------ : -
TrMDHb7   : ------------------------------------------------------ : -
TrMDHb8   : ------------------------------------------------------ : -
TrMDHb9   : ------------------------------------------------------ : -
TrMDHb10  : ------------------------------------------------------ : -
TrMDHb11  : ------------------------------------------------------ : -
TrMDHb12  : ------------------------------------------------------ : -
TrMDHb13  : ------------------------------------------------------ : -
TrMDHb14  : ------------------------------------------------------ : -
TrMDHb15  : ------------------------------------------------------ : -
TrMDHb16  : ------------------------------------------------------ : -
TrMDHb17  : ------------------------------------------------------ : -
TrMDHb18  : ------------------------------------------------------ : -
TrMDHb19  : ------------------------------------------------------ : -
TrMDHb20  : ------------------------------------------------------ : -
TrMDHb21  : ------------------------------------------------------ : -
TrMDHb22  : ------------------------------------------------------ : -
TrMDHb23  : ------------------------------------------------------ : -
TrMDHb24  : ------------------------------------------------------ : -
TrMDHb25  : TGGTTGAATGGAGAATTCATATCTACCGTTCAACAACGTGGTGCTG--------- : 752
TrMDHb26  : ------------------------------------------------------ : -
TrMDHb27  : ------------------------------------------------------ : -
TrMDHb28  : ------------------------------------------------------ : -
TrMDHb29  : ------------------------------------------------------ : -
TrMDHb30  : TGGTTGAATGGAGAATTCATATCTACCGTTCAACAACGTGGTGCTGCAATTATTAAGGCT : 582
TrMDHb31  : TGGTTGAATGGAGAATTCATATCTACCGTTCAACAACGTGGTGCTGCAATTATTAAGGCT : 424
TrMDHb32  : TGGTTGAATGGAGAATTCATATCTACCGTTCAACAACGTGGTGCTGCAATTATTAAGGCT : 424
```

FIGURE 10 (cont.)

```
                *      860       *      880       *      900
TrMDHb1   : ---------------------------------------------------- :   -
TrMDHb2   : ---------------------------------------------------- :   -
TrMDHb3   : ---------------------------------------------------- :   -
TrMDHb4   : ---------------------------------------------------- :   -
TrMDHb5   : ---------------------------------------------------- :   -
TrMDHb6   : ---------------------------------------------------- :   -
TrMDHb7   : ---------------------------------------------------- :   -
TrMDHb8   : ---------------------------------------------------- :   -
TrMDHb9   : ---------------------------------------------------- :   -
TrMDHb10  : ---------------------------------------------------- :   -
TrMDHb11  : ---------------------------------------------------- :   -
TrMDHb12  : ---------------------------------------------------- :   -
TrMDHb13  : ---------------------------------------------------- :   -
TrMDHb14  : ---------------------------------------------------- :   -
TrMDHb15  : ---------------------------------------------------- :   -
TrMDHb16  : ---------------------------------------------------- :   -
TrMDHb17  : ---------------------------------------------------- :   -
TrMDHb18  : ---------------------------------------------------- :   -
TrMDHb19  : ---------------------------------------------------- :   -
TrMDHb20  : ---------------------------------------------------- :   -
TrMDHb21  : ---------------------------------------------------- :   -
TrMDHb22  : ---------------------------------------------------- :   -
TrMDHb23  : ---------------------------------------------------- :   -
TrMDHb24  : ---------------------------------------------------- :   -
TrMDHb25  : ---------------------------------------------------- :   -
TrMDHb26  : ---------------------------------------------------- :   -
TrMDHb27  : ---------------------------------------------------- :   -
TrMDHb28  : ---------------------------------------------------- :   -
TrMDHb29  : ---------------------------------------------------- :   -
TrMDHb30  : AGAAAGCTTTCAAGCG------------------------------------- : 598
TrMDHb31  : AGAAAGCTTTCAAGCGCACTATCCGCTGCTAGCGCTGCTTGCGACCACATTCGCGATTGG : 484
TrMDHb32  : AGAAAGCTTTCAAGCGCACTATCCGCTGCTAGCGCTGCTTGCGACCACATTCGCGATTGG : 484
```

FIGURE 10 (cont.)

```
              *        920        *        940        *        960
TrMDHb1   : ------------------------------------------------------------ : -
TrMDHb2   : ------------------------------------------------------------ : -
TrMDHb3   : ------------------------------------------------------------ : -
TrMDHb4   : ------------------------------------------------------------ : -
TrMDHb5   : ------------------------------------------------------------ : -
TrMDHb6   : ------------------------------------------------------------ : -
TrMDHb7   : ------------------------------------------------------------ : -
TrMDHb8   : ------------------------------------------------------------ : -
TrMDHb9   : ------------------------------------------------------------ : -
TrMDHb10  : ------------------------------------------------------------ : -
TrMDHb11  : ------------------------------------------------------------ : -
TrMDHb12  : ------------------------------------------------------------ : -
TrMDHb13  : ------------------------------------------------------------ : -
TrMDHb14  : ------------------------------------------------------------ : -
TrMDHb15  : ------------------------------------------------------------ : -
TrMDHb16  : ------------------------------------------------------------ : -
TrMDHb17  : ------------------------------------------------------------ : -
TrMDHb18  : ------------------------------------------------------------ : -
TrMDHb19  : ------------------------------------------------------------ : -
TrMDHb20  : ------------------------------------------------------------ : -
TrMDHb21  : ------------------------------------------------------------ : -
TrMDHb22  : ------------------------------------------------------------ : -
TrMDHb23  : ------------------------------------------------------------ : -
TrMDHb24  : ------------------------------------------------------------ : -
TrMDHb25  : ------------------------------------------------------------ : -
TrMDHb26  : ------------------------------------------------------------ : -
TrMDHb27  : ------------------------------------------------------------ : -
TrMDHb28  : ------------------------------------------------------------ : -
TrMDHb29  : ------------------------------------------------------------ : -
TrMDHb30  : ------------------------------------------------------------ : -
TrMDHb31  : GTTCTTGGAACTCCCCAGGGCACCTTCGTTTCAATGGGAGTGTATTCTGATGGTTCTTAC : 544
TrMDHb32  : GTTCTTGGAACTCCCCAGGGCACCTTCGTTTCAATGGGAGTGTATTCTGATGGTTCTTAC : 544
```

FIGURE 10 (cont.)

|          |   | * | 980 | * | 1000 | * | 1020 |   |     |
|----------|---|---|-----|---|------|---|------|---|-----|
| TrMDHb1  | : | ---------------------------------------------------------- | : | -   |
| TrMDHb2  | : | ---------------------------------------------------------- | : | -   |
| TrMDHb3  | : | ---------------------------------------------------------- | : | -   |
| TrMDHb4  | : | ---------------------------------------------------------- | : | -   |
| TrMDHb5  | : | ---------------------------------------------------------- | : | -   |
| TrMDHb6  | : | ---------------------------------------------------------- | : | -   |
| TrMDHb7  | : | ---------------------------------------------------------- | : | -   |
| TrMDHb8  | : | ---------------------------------------------------------- | : | -   |
| TrMDHb9  | : | ---------------------------------------------------------- | : | -   |
| TrMDHb10 | : | ---------------------------------------------------------- | : | -   |
| TrMDHb11 | : | ---------------------------------------------------------- | : | -   |
| TrMDHb12 | : | ---------------------------------------------------------- | : | -   |
| TrMDHb13 | : | ---------------------------------------------------------- | : | -   |
| TrMDHb14 | : | ---------------------------------------------------------- | : | -   |
| TrMDHb15 | : | ---------------------------------------------------------- | : | -   |
| TrMDHb16 | : | ---------------------------------------------------------- | : | -   |
| TrMDHb17 | : | ---------------------------------------------------------- | : | -   |
| TrMDHb18 | : | ---------------------------------------------------------- | : | -   |
| TrMDHb19 | : | ---------------------------------------------------------- | : | -   |
| TrMDHb20 | : | ---------------------------------------------------------- | : | -   |
| TrMDHb21 | : | ---------------------------------------------------------- | : | -   |
| TrMDHb22 | : | ---------------------------------------------------------- | : | -   |
| TrMDHb23 | : | ---------------------------------------------------------- | : | -   |
| TrMDHb24 | : | ---------------------------------------------------------- | : | -   |
| TrMDHb25 | : | ---------------------------------------------------------- | : | -   |
| TrMDHb26 | : | ---------------------------------------------------------- | : | -   |
| TrMDHb27 | : | ---------------------------------------------------------- | : | -   |
| TrMDHb28 | : | ---------------------------------------------------------- | : | -   |
| TrMDHb29 | : | ---------------------------------------------------------- | : | -   |
| TrMDHb30 | : | ---------------------------------------------------------- | : | -   |
| TrMDHb31 | : | AACGTACCAGCTGGACTCATCTATTCATTCCCTGTCACCACTGCTAATGGGGAATGGAA- | : | 603 |
| TrMDHb32 | : | AACGTACCAGCTGGACTCATCTATTCATTCCCTGTCACCACTGCTAATGGGGAATGGAAA | : | 604 |

FIGURE 10 (cont.)

```
              *      1040       *      1060       *      1080
TrMDHb1   : ------------------------------------------------------------ : -
TrMDHb2   : ------------------------------------------------------------ : -
TrMDHb3   : ------------------------------------------------------------ : -
TrMDHb4   : ------------------------------------------------------------ : -
TrMDHb5   : ------------------------------------------------------------ : -
TrMDHb6   : ------------------------------------------------------------ : -
TrMDHb7   : ------------------------------------------------------------ : -
TrMDHb8   : ------------------------------------------------------------ : -
TrMDHb9   : ------------------------------------------------------------ : -
TrMDHb10  : ------------------------------------------------------------ : -
TrMDHb11  : ------------------------------------------------------------ : -
TrMDHb12  : ------------------------------------------------------------ : -
TrMDHb13  : ------------------------------------------------------------ : -
TrMDHb14  : ------------------------------------------------------------ : -
TrMDHb15  : ------------------------------------------------------------ : -
TrMDHb16  : ------------------------------------------------------------ : -
TrMDHb17  : ------------------------------------------------------------ : -
TrMDHb18  : ------------------------------------------------------------ : -
TrMDHb19  : ------------------------------------------------------------ : -
TrMDHb20  : ------------------------------------------------------------ : -
TrMDHb21  : ------------------------------------------------------------ : -
TrMDHb22  : ------------------------------------------------------------ : -
TrMDHb23  : ------------------------------------------------------------ : -
TrMDHb24  : ------------------------------------------------------------ : -
TrMDHb25  : ------------------------------------------------------------ : -
TrMDHb26  : ------------------------------------------------------------ : -
TrMDHb27  : ------------------------------------------------------------ : -
TrMDHb28  : ------------------------------------------------------------ : -
TrMDHb29  : ------------------------------------------------------------ : -
TrMDHb30  : ------------------------------------------------------------ : -
TrMDHb31  : ------------------------------------------------------------ : -
TrMDHb32  : ATTGTTCAAGGACTTTCAATTGACGAGTTCTCAAGGAAGAAGTTGGACTTGACAGCTGAA : 664
```

FIGURE 10 (cont.)

```
                        *         1100         *
TrMDHb1  : ------------------------------ : -
TrMDHb2  : ------------------------------ : -
TrMDHb3  : ------------------------------ : -
TrMDHb4  : ------------------------------ : -
TrMDHb5  : ------------------------------ : -
TrMDHb6  : ------------------------------ : -
TrMDHb7  : ------------------------------ : -
TrMDHb8  : ------------------------------ : -
TrMDHb9  : ------------------------------ : -
TrMDHb10 : ------------------------------ : -
TrMDHb11 : ------------------------------ : -
TrMDHb12 : ------------------------------ : -
TrMDHb13 : ------------------------------ : -
TrMDHb14 : ------------------------------ : -
TrMDHb15 : ------------------------------ : -
TrMDHb16 : ------------------------------ : -
TrMDHb17 : ------------------------------ : -
TrMDHb18 : ------------------------------ : -
TrMDHb19 : ------------------------------ : -
TrMDHb20 : ------------------------------ : -
TrMDHb21 : ------------------------------ : -
TrMDHb22 : ------------------------------ : -
TrMDHb23 : ------------------------------ : -
TrMDHb24 : ------------------------------ : -
TrMDHb25 : ------------------------------ : -
TrMDHb26 : ------------------------------ : -
TrMDHb27 : ------------------------------ : -
TrMDHb28 : ------------------------------ : -
TrMDHb29 : ------------------------------ : -
TrMDHb30 : ------------------------------ : -
TrMDHb31 : ------------------------------ : -
TrMDHb32 : GAGTTATCCGAGGAAAAGAGTTTGGCATACT : 695
```

```
                  *       200          *       220         *      240         *
TrMDHc1  : GCTACCGAACCAGTTCCAGAACGCAAGGTGGCCATTCTCGGTGCTGCCGGCGGGATCGGACAG : 248
TrMDHc2  : GCTACCGAACCAGTTCCAGAACGCAAGGTGGCCATTCTCGGTGCTGCCGGCGGGATCGGACAG : 245
TrMDHc3  : GCTACCGAACCAGTTCCAGAACGCAAGGTGGCCATTCTCGGCGCTGCCGGCGGGATCGGCCAG : 231
TrMDHc4  : GCTACCGAACCAGTTCCAGAACGCAAGGTGGCCATTCTCGGTGCTGCCGGCGGGATCGCACAG : 217
TrMDHc5  : GCTACCGAACCAGTTCCAGAACGCAAGGTGGCCATTCTCGGCGCTGCCGGCGGGATCGGCCAG : 214
TrMDHc6  : GCTACCGAACCAGTTCCAGAACGCAAGGTGGCCATTCTCGGCGCTGCCGGCGGGATCGGCCAG : 213
TrMDHc7  : GCTACCGAACCAGTTCCAGAACGCAAGGTGGCCATTCTCGGCGCTGCCGGCGGGATCGGCCAG : 216
TrMDHc8  : GCTACCGAACCAGTTCCAGAACGCAGGTGGCCATTCTCGGTGCTGCTGGCGGGATCGGACAG  : 215
TrMDHc9  : GCTACCGAACCAGTTCCAGAACGCAAGGTGGCCATTCTCGGCGCTGCCGGCGGGATCGGCCAG : 213
TrMDHc10 : GCTACCGAACCAGTTCCAGAACGCAAGGNGGCCATTCTCGGCGCTGCCGGCGGGATCGGCCAG : 212
TrMDHc11 : GCTACCGAACCAGTTCCAGAACGCAAGGTGGCCATTCTCGGCGCTGCCGGCGGGATCGGCCAG : 174
TrMDHc12 : GCTACCGAACCAGTTCCAGAACGCAAGGTGGCCATTCTCGGCGCTGCTGGCGGGATCGGCCAG : 171
TrMDHc13 : GCTACCGAACCAGTTCCAGAACGCAAGGNGGCCATTCTCGGTGCTGCCGGCGGGATCGGACAG : 174
TrMDHc14 : ------------------------------------------------------------- :   -
TrMDHc15 : ------------------------------------------------------------- :   -
TrMDHc16 : ------------------------------------------------------------- :   -
TrMDHc17 : ------------------------------------------------------------- :   -

260       *       280         *       300         *
TrMDHc1  : CCTCTCTCTCTTCTCATGAAGCTCAACCCTCTCGTTTCAACCCTATCTCTTTATGATATTGCT : 311
TrMDHc2  : CCTCTCTCTCTTCTCATGAAGCTCAACCCTCTCGTTTCAACCCTATCTCTTTATGATATTGCT : 308
TrMDHc3  : CCTCTCTCTCTTCTCATGAAGCTCAACCCTCTCGTTTCAACCCTATCTCTTTATGATATTGCT : 294
TrMDHc4  : CCTCTCTCTCTTCTCATGAAGCTCAACCCTCTCGTTTCAACCCTATCTCTTTATGATATTGCT : 280
TrMDHc5  : CCTCTCTCTCTTCTCATGAAGCTCAACCCTCTCGTTTCAACCCTATCTCTTTATGATATTGCT : 277
TrMDHc6  : CCTCTCTCTCTTCTCATGAAGCTCAACCCTCTCGTTTCAACCCTATCTCTTTATGATATTGCT : 276
TrMDHc7  : CCTCTCTCTCTTCTCATGAAGCTCAACCCTCTCGTTTCAACCCTATCTCTTTATGATATTGCT : 279
TrMDHc8  : CCTCTCTCTCTTCTCATGAAGCTCAACCCTCTCGTTTCAACCCTATCTCTTTATGATATTGCT : 278
TrMDHc9  : CCTCTCTCTCTTCTCATGAAGCTCAACCCTCTCGTTTCAACCCTATCTCTTTATGATATTGCT : 276
TrMDHc10 : CCTCTCTCTCTTCTCATGAAGCTCAACCCTCTCGTTTCAACCCTATCTCTTTATGATATTGCT : 275
TrMDHc11 : CCTCTCTCTCTTCTCATGAAGCTCAACCCTCTCGTTTCAACCCTATCTCTTTATGATATTGCT : 237
TrMDHc12 : CCTCTCTCTCTTCTCATGAAGCTCAANCCTCTCGTTTCAACCCTATCTCTTTATGATATTGCT : 234
TrMDHc13 : CCTCTCTCTCTTCTCATGAAGCTCAACCCTCTCGTTTCAACCCTATCTCTTTATGATATTGCT : 237
TrMDHc14 : ------------------------------------------------------------- :   -
TrMDHc15 : ------------------------------------------------------------- :   -
TrMDHc16 : ------------------------------------------------------------- :   -
TrMDHc17 : ------------------------------------------------------------- :   -

320         *       340          *       360        *    3
TrMDHc1  : GGAACCCCTGGTGTCGCCGCTGATGTCAGCCACATCAACTCCAGATCTGAGGTAACTGGGTAT : 374
TrMDHc2  : GGAACCCCTGGTGTCGCCGCTGATGTCAGCCACATCAACTCCAGATCTGAGGTAACTGGGTAT : 371
TrMDHc3  : GGAACCCCTGGTGTCGCCGCTGATGTCAGCCACATCAACTCCAGATCTGAGGTAACTGGGTAT : 357
TrMDHc4  : GGAACCCCTGGTGTCGCCGCTGATGTCAGCCACATCAACTCCAGATCTGAGCTAACTGGGTAT : 343
TrMDHc5  : GGAACCCCTGGTGTCGCCGCTGATGTCAGCCACATCAACTCCAGATCTGAGGTAACTGGGTAT : 340
TrMDHc6  : GGAACCCCTGGTGTCGCCGCTGATGTCAGCCACATCAACTCCAGATCTGAGGTAACTGGGTAT : 339
TrMDHc7  : GGAACCCCTGGTGTCGCCGCTGATGTCAGCCACATCAACTCCAGATCTGAGGTAACTGGGTAT : 342
TrMDHc8  : GGAACCCCTGGTGTCGCCGCTGATGTCAGCCACATCAACTCCAGATCTGAGGTAACTGGGTAT : 341
TrMDHc9  : GGAACCCCTGGTGTCGCCGCTGATGTCAGCCACATCAACTCCAGATCTGAGGTAACTGGGTAT : 339
TrMDHc10 : GGAACCCCTGGTGTCGCCGCTGATGTCAGCCACATCAACTCCAGATCTGAGGTAACTGGGTAT : 338
TrMDHc11 : GGAACCCCTGGTGTCGCCGCTGATGTCAGCCACATCAACTCCAGATCTGAGGTAACTGGGTAT : 300
TrMDHc12 : GGAACCCCTGGTGTCGCCGCTGATGTCAGCCACATCAACTCCAGATCTGAGGTAACTGGGTAT : 297
TrMDHc13 : GGAACCCCTGGTGTCGCCGCTGATGTCAGCCACATCAACTCCAGATCTGAGGTAACTGGGTAT : 300
TrMDHc14 : --------CNGTGTCGCCGCTGNNGTCAGCCACATCAACTCCANANCTGA-GTAACTGGGTAT :  54
TrMDHc15 : ----------------GNTGATGT-NGCC-CAT-AACTCC-GATCTGAGGTAACTGGGTAT   :  41
TrMDHc16 : ------------------------------------------------------------- :   -
TrMDHc17 : ------------------------------------------------------------- :   -
```

FIGURE 11 (cont.)

```
              80          *        400         *        420         *        440
TrMDHc1  : GCAGGTGAAGAAGAGCTTGGAAAAGCTTTGGAGGGTGCTGATGTTGTTATAATTCCTGCTGGT : 437
TrMDHc2  : GCAGGTGAAGAAGAGCTTGGAAAAGCTTTGGAGGGTGCTGATGTTGTTATAATTCCTGCTGGT : 434
TrMDHc3  : GCAGGTGAAGAAGAGCTTGGAAAAGCTTTGGAGGGTGCTGATGTTGTTATAATTCCTGCGGT  : 420
TrMDHc4  : GCAGGTGAAGAAGAGCTTGGAAAAGCTTTGGAGGGTGCTGATGTTGTTATAATTCCTGCTGGT : 406
TrMDHc5  : GCAGGTGAAGAAGAGCTTGGAAAAGCTTTGGAGGGTGCTGATGTTGTTATAATTCCTGCGGT  : 403
TrMDHc6  : GCAGGTGAAGAAGAGCTTGGAAAAGCTTTGGAGGGTGCTGATGTTGTTATAATTCCTGCGGT  : 402
TrMDHc7  : GCAGGTGAAGAAGAGCTTGGAAAAGCTTTGGAGGGTGCTGATGTTGTTATAATTCCTGCGGT  : 405
TrMDHc8  : GCAGGTGAAGAAGAGCTTGGAAAAGCTTTGGAGGGTGCTGATGTTGTTATAATTCCTGCTGGT : 404
TrMDHc9  : GCAGGTGAAGAAGAGCTTGGAAAAGCTTTGGAGGGTGCTGATGTTGTTATAATTCCTGCGGT  : 402
TrMDHc10 : GCAGGTGAAGAAGAGCTTGGAAAAGCTTTGGAGGGTGCTGATGTTGTTATAATTCCTGCGGT  : 401
TrMDHc11 : GCAGGTGAAGAAGAGCTTGGAAAAGCTTTGGAGGGTGCTGATGTTGTTATAATTCCTGCGGT  : 363
TrMDHc12 : GCAGGTGAAGAAGAGCTTGGAAAAGCTTTGGAGGGTGCTGATGTTGTTATAATTCCTGCTGGT : 360
TrMDHc13 : GCAGGTGAAGAAGAGCTTGGAAAAGCTTTGGAGGGTGCTGATGTTGTTATAATTCCTGCTGGT : 363
TrMDHc14 : GCAGGTGAAGAAGAGCTTGGAAAAGCTTTGGAGGGTGCTGATGTTGTTATAATTCCTGCTGGT : 117
TrMDHc15 : GCAGGTGAAGAAGAGCTTGGAAAAGCTTTGGAGGGTGCTGATGTTGTTATAATTCCTGCTGGT : 104
TrMDHc16 : ------------------------------------------------------------ : -
TrMDHc17 : ------------------------------------------------------------ : -

*         460         *        480         *        500
TrMDHc1  : GTGCCCAGAAAGCCTGGAATGACTCGTGATGATCTTTTCAATATTAACGCTGGCATTGTCAAG : 500
TrMDHc2  : GTGCCCAGAAAGCCTGGAATGACTCGTGATGATCTTTTCAATATTAACGCTGGCATTGTCAAG : 497
TrMDHc3  : GTGCCCAGAAAGCCTGGAATGACTCGTGATGATCTTTTCAATATTAACGCTGGCATTGTCAAG : 483
TrMDHc4  : GTGCCCAGAAAGCCTGGAATGACTCGTGATGATCTTTTCAATATTAACGCTGGCATTGTCAAG : 469
TrMDHc5  : GTGCCCAGAAAGCCTGGAATGACTCGTGATGATCTTTTCAATATTAACGCTGGCATTGTCAAG : 466
TrMDHc6  : GTGCCCAGAAAGCCTGGAATGACTCGTGATGATCTTTTCAATATTAACGCTGGCATTGTCAAG : 465
TrMDHc7  : GTGCCCAGAAAGCCTGGAATGACTCGTGATGATCTTTTCAATATTAACGCTGGCATTGTCAAG : 468
TrMDHc8  : GTGCCCAGAAAGCCTGGAATGACTCGTGATGATCTTTTCAATATTAACGCTGGCATTGTCAAG : 467
TrMDHc9  : GTGCCCAGAAAGCCTGGAATGACTCGTGATGATCTTTTCAATATTAACGCTGGCATTGTAAG  : 465
TrMDHc10 : GTGCCCAGAAAGCCTGGAATGACTCGTGATGATCTTTTCAATATTAACGCTGGCATTGTCAAG : 464
TrMDHc11 : GTGCCCAGAAAGCCTGGAATGACTCGTGATGATCTTTTCAATATTAACGCTGGCATTGTCAAG : 426
TrMDHc12 : GTGCCCAGAAAGCCTGGAATGACTCGTGATGATCTTTTCAATATTAACGCTGGCATTGTCAAG : 423
TrMDHc13 : GTGCCCAGAAAGCCTGGAATGACTCGTGATGATCTTTTCAATATTAACGCTGGCATTGTCAAG : 426
TrMDHc14 : GTGCCCAGAAAGCCTGGAATGACTCGTGATGATCTTTTCAATATTAACGCTGGCATTGTCAAG : 180
TrMDHc15 : GTGCCCAGAAAGCCTGGAATGACTCGTGATGATCTTTTCAATATTAACGCTGGCATTGTCAAG : 167
TrMDHc16 : ------------------------------------------------------------ : -
TrMDHc17 : ------------------------------------------------------------ : -

*         520         *        540         *        560
TrMDHc1  : TCACTTGCCACTGCTATTTCTAAGTACTGCCCCCATG----------------------- : 537
TrMDHc2  : TCACTTGCCACTGCTATTTCTAAGTACTGCCCCCATGCCCTTGTTAACATGATAAGCAACCCT : 560
TrMDHc3  : TCACTTGCCACTGCTATTTCTAAGTACTGCCCCCATGCCCTTGTTAACATGATAAGCAACCCT : 546
TrMDHc4  : TCACTTGCCACTGCTATTTCTAAGTACTGCCCCCATGCCCTTGTTAACATGATAAGCAACCCT : 532
TrMDHc5  : TCACTTGCCACTGCTATTTCTAAGTACTGCCCCCATGCCCTTGTTAACATGATAAGCAACCCT : 529
TrMDHc6  : TCACTTGCCACTGCTATTTCTAAGTACTGCCCCCATGCCCTTGTTAACATGATAAGCAACCCT : 528
TrMDHc7  : TCACTTGCCACTGCTATTTCTAAGTACTGCCCCCATGCCCTTGTTAACATGATAAGCAACCCT : 531
TrMDHc8  : TCACTTGCCACTGCTATTTCTAAGTACTGCCCCCATGCCCTTGTTAACATGATAAGCAACCCT : 530
TrMDHc9  : TCACTTGCCACTGCTATTTCTAAGTACTGCCCCCATGCCCTTGTTAACATGATAAGCAACCCT : 528
TrMDHc10 : TCACTTGCCACTGCTATTTCTAAGTACTGCCCCCATGCCCTTGTTAACATGATAAGCAACCCT : 527
TrMDHc11 : TCACTTGCCACTGCTATTTCTAAGTACTGCCCCCATGCCCTTGTTAACATGATAAGCAACCCT : 489
TrMDHc12 : TCACTTGCCACTGCTATTTCTAAGTACTGCCCCCATGCCCTTGTTAACATGATAAGCAACCCT : 486
TrMDHc13 : TCACTTGCCACTGCTATTTCTAAGTACTGCCCCCATGCCCTTGTTAACATGATAAGCAACCCT : 489
TrMDHc14 : TCACTTGCCACTGCTATTTCTAAGTACTGCCCCCATGCCCTTGTTAACATGATAAGCAACCCT : 243
TrMDHc15 : TCACTTGCCACTGCTATTTCTAAGTACTGCCCCCATGCCCTTGTTAACATGATAAGCAACCCT : 230
TrMDHc16 : ---------------------------------------------------ATG--- : 3
TrMDHc17 : ------------------------------------------------------------ : -
```

FIGURE 11 (cont.)

```
              *         580         *         600         *         620         *
TrMDHc1  : ------------------------------------------------------------  :   -
TrMDHc2  : GTGAACTCCACCGTTCCCATTGCTGCAGAGGTTTTCAAGAAGGCAGGG------------- : 608
TrMDHc3  : GTGAACTCCACCGTTCCCATTGCTGCAGC-------------------------------- : 575
TrMDHc4  : GTGAACTCCACCGTTCCCATTGCTGCAGAGG------------------------------ : 563
TrMDHc5  : GTGAACTCCACCGTTCCCATTGCTGCAGAGGTTTTCAAGAAGGCAGGGACATAT------- : 583
TrMDHc6  : GTGAACTCCACCGTTCCCATTGCTGCAGAGGTTTTCAAGAAGGCAGGGACATATGACGAGAAC : 591
TrMDHc7  : GTGAACTCCACCGTTCCCATTGCTGCAGAGGTTTTCAAGAAGGCAGGGACATATGACGAGAAG : 594
TrMDHc8  : GTGAACTCCACCGTTCCCATTGCTGC----------------------------------- : 556
TrMDHc9  : GTGAACTCCACCGTTCCCATTGCTGCAGAGGTTTTCAAGAAGGCAGGGACATATGACGAGAAG : 591
TrMDHc10 : GTGAACTCCACCGTTCCCATTGCTGNAGAGGTTTTCAAGAAGGCNGGGACATATGACNAGAAN : 590
TrMDHc11 : GTGAACTCCACCGTTCCCATTGCTGCAGAGGTTTTCAAGAAGGCAGGGACATATGACGAGAAG : 552
TrMDHc12 : GTGAACTCCACCGTTCCCATTGCTGCAGAGGTTTTCAAGAAGGCAGGGACATATGACGAGAAG : 549
TrMDHc13 : GTGAACTCCACCGTTCCCATTGCTGCANAGGTTTTCAAGAAGGCAGGGACATATGACNAGAAG : 552
TrMDHc14 : GTGAACTCCACCGTTCCCATTGCTGCAGAGGTTTTCAAGAAGGCAGGGACATATGACGAGAAG : 306
TrMDHc15 : GTGAACTCCACCGTTCCCATTGCTGCAGAGGTTTTCAAGAAGGCAGGGACATATGACGAGAAG : 293
TrMDHc16 : ------------------------------------------------------------ :   -
TrMDHc17 : ------------------------------------------------------------ :   -

640         *         660         *         680         *
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : AGATTGT----------------------------------------------------- : 598
TrMDHc7  : AGATTGTTTGGGGTTACAACCCTTGATGTAGTCAGGGCAAAACTTTCTATGCCGGGAAAGCT : 657
TrMDHc8  : ------------------------------------------------------------ :   -
TrMDHc9  : AGATTGTTTGGGGTTACAACCCTTGATGTAGTCAGGGCAAAACTTTCTATGCCGGGAAAGCT : 654
TrMDHc10 : ANATTGTTTGGGGTT-CAACCCTTGATGTAGTCAGGGCCAAAACTTTTTTGCCGGGAAAGCT : 652
TrMDHc11 : AGATTGTTTGGGGTTACAACCCTTG----------------------------------- : 577
TrMDHc12 : AGATTGTTTGGGGTTACAACCCTTGATGTAGTCAGGGCAAAACT---------------- : 594
TrMDHc13 : AGATTGTTTGGGGTTACAACCCTTGATGTAGNCAGGGCAAAACTTTCTATGCCGGGAAAGCT : 615
TrMDHc14 : AGATTGTTTGGGGTTACAACCCTTGATGTAGTCAGGGCAAAACTTTCTATGCCGGGAAAGCT : 369
TrMDHc15 : AGATTGTTTGGGGTTACAACCCTTGATGTAGTCAGGGCAAAACTTTCTATGCCGGGAAAGCT : 356
TrMDHc16 : ------------------------------------------------------------ :   -
TrMDHc17 : ------------------------------------------------------------ :   -

700         *         720         *         740         *
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : AAAGTTCCAGTTGCCGAGGTCAATGTACCTGTTTNTGGAGGCCATGCAGGAGTTACTATTNTT : 720
TrMDHc8  : ------------------------------------------------------------ :   -
TrMDHc9  : AAAGTTCCAGTTGCCGAGGTCAATGTAC-------------------------------- : 682
TrMDHc10 : AAAGTTCCAGTTGCCGNGGGNAATGNNCCTGTTNTNGGAGGC-TGC-NGAG-TNCTATT-NT : 711
TrMDHc11 : ------------------------------------------------------------ :   -
TrMDHc12 : ------------------------------------------------------------ :   -
TrMDHc13 : AAAGTTCCAGTTGCCGAGGNCAATGNACCTGTTATAGGAGGCCATGCAGGAGTTACTATTCTN : 678
TrMDHc14 : AAAGTTCCAGTTGCCGAGGTCAATGTACCTGTTATAGGAGGCCATGCAGGAGTTACTATTCTC : 432
TrMDHc15 : AAAGTTCCAGTTGCCGAGGTCAATGTACCTGTTATAGGAGGCCATGCAGGAGTTACTATTCTC : 419
TrMDHc16 : ------------------------------------------------------------ :   -
TrMDHc17 : ------------------------------------------------------------ :   -
```

FIGURE 11 (cont.)

```
              760         *         780         *         800         *         82
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : CCATTATTTTNTAAGG-AACACCTNAAGCCAATNTGCNTGATGAAACCCTTNAGGNTTTAACG : 782
TrMDHc8  : ------------------------------------------------------------ :   -
TrMDHc9  : ------------------------------------------------------------ :   -
TrMDHc10 : CCCTTTTTTTTTTAGG-CANNCCT-NANCCANT-TNGGNGATNAAA-CCTTAAGGCTTT-ACG : 769
TrMDHc11 : ------------------------------------------------------------ :   -
TrMDHc12 : ------------------------------------------------------------ :   -
TrMDHc13 : CCATTATTTTNTNAGGCAACACCTNAAGCCAATNTGGTGANGATNCCCTTAAGGNTTTAACG : 741
TrMDHc14 : CCATTATTTTCTCAGGCAACACCTCAAGCCAATCTGCATGATGATACCATTAAGGCTCTAACG : 495
TrMDHc15 : CCATTATTTTCTCAGGCAACACCTCAAGCCAATCTGCATGATGATACCATTAAGGCTCTAACG : 482
TrMDHc16 : ------------------------------------------------------------ :   -
TrMDHc17 : ------------------------------------------------------------ :   -

0           *         840         *         860         *         880
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : GNANGGCNCAAGATGGCGGAACNGAA-TTGNGACCGCCAAGGGTT---------------- : 827
TrMDHc8  : ------------------------------------------------------------ :   -
TrMDHc9  : ------------------------------------------------------------ :   -
TrMDHc10 : GG-NNGCCNCAAAANG-GGGAACAAAA-NTINGAC-------------------------- : 801
TrMDHc11 : ------------------------------------------------------------ :   -
TrMDHc12 : ------------------------------------------------------------ :   -
TrMDHc13 : GNANGGACCCAANANGGAGGAACANAANTTNNGACCCCCANGG-TGG-AAGGGTTNT-NNACT : 801
TrMDHc14 : GCAAGGACACAAGATGGAGGAACAGAAGTTCGGACCGCCAAGGCTGGAAAGGGTTCTGCAACT : 558
TrMDHc15 : GCAAGGACACAAGATGGAGGAACAGAAGTTCGGACCGCCAAGGCTGGAAAGGGTTCTGCAACT : 545
TrMDHc16 : ------------------------------------------------------------ :   -
TrMDHc17 : ------------------------------------------------------------ :   -

*         900         *         920         *         940
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : ------------------------------------------------------------ :   -
TrMDHc8  : ------------------------------------------------------------ :   -
TrMDHc9  : ------------------------------------------------------------ :   -
TrMDHc10 : ------------------------------------------------------------ :   -
TrMDHc11 : ------------------------------------------------------------ :   -
TrMDHc12 : ------------------------------------------------------------ :   -
TrMDHc13 : TT-NNAATCCN------------------------------------------------- : 811
TrMDHc14 : TTGTCAATGGCTTATGCTGGAGCCATATTTGCTGATGCTGGCCTCAAAGGTCTGAATGGAGTT : 621
TrMDHc15 : TTGTCAATGGCT------------------------------------------------ : 557
TrMDHc16 : -----------------------------CTGNTGCTNGCCT-NANGGNCTGAATGGAGTT :  34
TrMDHc17 : ---------------------------------------------------GNGNGTT :   7
```

FIGURE 11 (cont.)

```
              *         960         *         980         *        1000
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : ------------------------------------------------------------ :   -
TrMDHc8  : ------------------------------------------------------------ :   -
TrMDHc9  : ------------------------------------------------------------ :   -
TrMDHc10 : ------------------------------------------------------------ :   -
TrMDHc11 : ------------------------------------------------------------ :   -
TrMDHc12 : ------------------------------------------------------------ :   -
TrMDHc13 : ------------------------------------------------------------ :   -
TrMDHc14 : CCAGATGTTATTGAGTGCTCATATGTGCAATCCAATATCATCTCTGACCTTNCTTTCTTTGCT : 684
TrMDHc15 : ------------------------------------------------------------ :   -
TrMDHc16 : -CNGANGTTATTGAACTCTCATATGTGCAATCCAATATCATCTNTGACCTTCCTTTCTTTGCT :  96
TrMDHc17 : CCAGATGTTATNGAGTGCT-NTATGTGC-AT-CNATAT-NTCTCTGACCTTCCTTTCTTTGCT :  66

*        1020         *        1040         *        1060         *
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : ------------------------------------------------------------ :   -
TrMDHc8  : ------------------------------------------------------------ :   -
TrMDHc9  : ------------------------------------------------------------ :   -
TrMDHc10 : ------------------------------------------------------------ :   -
TrMDHc11 : ------------------------------------------------------------ :   -
TrMDHc12 : ------------------------------------------------------------ :   -
TrMDHc13 : ------------------------------------------------------------ :   -
TrMDHc14 : TCCAAGGTGAGGATTGGGAANAATGGTGTGGCAANAAT----------------------- : 722
TrMDHc15 : ------------------------------------------------------------ :   -
TrMDHc16 : TCCAAGGNNNGGATTGGGAAGAATGGTGTGGAAGAGATTCTG------------------- : 138
TrMDHc17 : TCC-AGGTGAGGATTGGGAAGAATGGTGTGGAAGAAATTCTGGGCTTAGGTTCTCTCACAGAT : 128

1080         *        1100         *        1120         *
TrMDHc1  : ------------------------------------------------------------ :   -
TrMDHc2  : ------------------------------------------------------------ :   -
TrMDHc3  : ------------------------------------------------------------ :   -
TrMDHc4  : ------------------------------------------------------------ :   -
TrMDHc5  : ------------------------------------------------------------ :   -
TrMDHc6  : ------------------------------------------------------------ :   -
TrMDHc7  : ------------------------------------------------------------ :   -
TrMDHc8  : ------------------------------------------------------------ :   -
TrMDHc9  : ------------------------------------------------------------ :   -
TrMDHc10 : ------------------------------------------------------------ :   -
TrMDHc11 : ------------------------------------------------------------ :   -
TrMDHc12 : ------------------------------------------------------------ :   -
TrMDHc13 : ------------------------------------------------------------ :   -
TrMDHc14 : ------------------------------------------------------------ :   -
TrMDHc15 : ------------------------------------------------------------ :   -
TrMDHc16 : ------------------------------------------------------------ :   -
TrMDHc17 : TTCGAGCAACAAGGCCTTGAAAACCTCAAGGCTGAACTCAAATCATCTATTGAAAAGGGAATC : 191
```

FIGURE 11 (cont.)

```
            1140       *     1160       *     1180      *      1
TrMDHc1  : ------------------------------------------------------- :   -
TrMDHc2  : ------------------------------------------------------- :   -
TrMDHc3  : ------------------------------------------------------- :   -
TrMDHc4  : ------------------------------------------------------- :   -
TrMDHc5  : ------------------------------------------------------- :   -
TrMDHc6  : ------------------------------------------------------- :   -
TrMDHc7  : ------------------------------------------------------- :   -
TrMDHc8  : ------------------------------------------------------- :   -
TrMDHc9  : ------------------------------------------------------- :   -
TrMDHc10 : ------------------------------------------------------- :   -
TrMDHc11 : ------------------------------------------------------- :   -
TrMDHc12 : ------------------------------------------------------- :   -
TrMDHc13 : ------------------------------------------------------- :   -
TrMDHc14 : ------------------------------------------------------- :   -
TrMDHc15 : ------------------------------------------------------- :   -
TrMDHc16 : ------------------------------------------------------- :   -
TrMDHc17 : AAATTTGCCTCCCAGTAATCGAACATGTCATACATTACTGGATTTTTCCATTTAGAACCAGAT : 254

200       *     1220       *     1240      *     1260
TrMDHc1  : ------------------------------------------------------- :   -
TrMDHc2  : ------------------------------------------------------- :   -
TrMDHc3  : ------------------------------------------------------- :   -
TrMDHc4  : ------------------------------------------------------- :   -
TrMDHc5  : ------------------------------------------------------- :   -
TrMDHc6  : ------------------------------------------------------- :   -
TrMDHc7  : ------------------------------------------------------- :   -
TrMDHc8  : ------------------------------------------------------- :   -
TrMDHc9  : ------------------------------------------------------- :   -
TrMDHc10 : ------------------------------------------------------- :   -
TrMDHc11 : ------------------------------------------------------- :   -
TrMDHc12 : ------------------------------------------------------- :   -
TrMDHc13 : ------------------------------------------------------- :   -
TrMDHc14 : ------------------------------------------------------- :   -
TrMDHc15 : ------------------------------------------------------- :   -
TrMDHc16 : ------------------------------------------------------- :   -
TrMDHc17 : CAAATTTTGCAAATTCAGAACAATTGTTTGTAATGTTGCCGGTAGGTATACCCCTAGATTTAA : 317

*     1280       *     1300      *     1320
TrMDHc1  : ------------------------------------------------------- :   -
TrMDHc2  : ------------------------------------------------------- :   -
TrMDHc3  : ------------------------------------------------------- :   -
TrMDHc4  : ------------------------------------------------------- :   -
TrMDHc5  : ------------------------------------------------------- :   -
TrMDHc6  : ------------------------------------------------------- :   -
TrMDHc7  : ------------------------------------------------------- :   -
TrMDHc8  : ------------------------------------------------------- :   -
TrMDHc9  : ------------------------------------------------------- :   -
TrMDHc10 : ------------------------------------------------------- :   -
TrMDHc11 : ------------------------------------------------------- :   -
TrMDHc12 : ------------------------------------------------------- :   -
TrMDHc13 : ------------------------------------------------------- :   -
TrMDHc14 : ------------------------------------------------------- :   -
TrMDHc15 : ------------------------------------------------------- :   -
TrMDHc16 : ------------------------------------------------------- :   -
TrMDHc17 : TAAGTAAATCTGCGAGAGCAGTTTATTGCTGCAGGGACTGAAATTAAAACCAGTTTTAGGTTG : 380
```

FIGURE 11 (cont.)

```
              *         1340         *         1360         *         1380
TrMDHc1   : ------------------------------------------------------------ : -
TrMDHc2   : ------------------------------------------------------------ : -
TrMDHc3   : ------------------------------------------------------------ : -
TrMDHc4   : ------------------------------------------------------------ : -
TrMDHc5   : ------------------------------------------------------------ : -
TrMDHc6   : ------------------------------------------------------------ : -
TrMDHc7   : ------------------------------------------------------------ : -
TrMDHc8   : ------------------------------------------------------------ : -
TrMDHc9   : ------------------------------------------------------------ : -
TrMDHc10  : ------------------------------------------------------------ : -
TrMDHc11  : ------------------------------------------------------------ : -
TrMDHc12  : ------------------------------------------------------------ : -
TrMDHc13  : ------------------------------------------------------------ : -
TrMDHc14  : ------------------------------------------------------------ : -
TrMDHc15  : ------------------------------------------------------------ : -
TrMDHc16  : ------------------------------------------------------------ : -
TrMDHc17  : GCCTTTCCATTCGTAATGGCCCTTCATTGTTGCATGNTTTCATATAATGCAATTGAAGGGTGN : 443

*        1400
TrMDHc1   : ---------------------- : -
TrMDHc2   : ---------------------- : -
TrMDHc3   : ---------------------- : -
TrMDHc4   : ---------------------- : -
TrMDHc5   : ---------------------- : -
TrMDHc6   : ---------------------- : -
TrMDHc7   : ---------------------- : -
TrMDHc8   : ---------------------- : -
TrMDHc9   : ---------------------- : -
TrMDHc10  : ---------------------- : -
TrMDHc11  : ---------------------- : -
TrMDHc12  : ---------------------- : -
TrMDHc13  : ---------------------- : -
TrMDHc14  : ---------------------- : -
TrMDHc15  : ---------------------- : -
TrMDHc16  : ---------------------- : -
TrMDHc17  : TGGNCANCGATACACANCCCCC : 465
```

FIGURE 11 (cont.)

```
              *        20         *        40         *        60
TrMDHd1 : GNGTAGGCGGAGATTTNAACCCATTTTCCTCTTAAATCTCTCTNAACTTCTCTTTCCATT : 60
TrMDHd2 : -GTTAGGCGGAGATTNNAACCCATTTTCCTCTTAAATCTCTCTC-ACTTCTCTTTCCATT : 58
TrMDHd3 : ------GGGAGATTTNAACCCATTTTCCTCTTAAATCTCTC-CCACTTCTCCTTCCATT : 52

*        80         *       100         *       120
TrMDHd1 : CCCATTACCATTCATTCCCAGAGGTCGAGATGGCAGCATCAGCAGCAGCTACTTTTACTA : 120
TrMDHd2 : CCCATTACCATTCATTCCCAGAGGTCGAGATGGCAGCATCAGCAGCAGCTACTTTTACTA : 118
TrMDHd3 : CCCATTACCATTCATTCCCAGACGTTGAGATGGCAGCATCAGCAGCAGCTACTTTTACTA : 112

*       140         *       160         *       180
TrMDHd1 : TTGGAACTGCCCAAACAGGGAGGCCACTTCCTCAATCAAACCCTTTTGGTTTGAAAGTCA : 180
TrMDHd2 : TTGGAACTGCCCAAACAGGGAGGCCACTTCCTCAATCAAACCCTTTTGGTTTGAAAGTCA : 178
TrMDHd3 : TTGGAACTGCCCAAACAGGGAGGCCACTTCCTCAATCAAACCCTTTTGGTTTGAAAGTCA : 172

*       200         *       220         *       240
TrMDHd1 : ATTCCCAGGTTAATTTTAAGACCTTCTCTGGTCTCAAGGCCATGTCATCTCTAAGATGCG : 240
TrMDHd2 : ATTCCCAGGTTAATTTTAAGACCTTCTCTGGTCTCAAGGCCATGTCATCTCTAAGATGCG : 238
TrMDHd3 : ATTCCCAGGTTAATTTTAAGACCTTCTCTGGTCTCAAGGCCATGTCCTCTCTAAGATGCG : 232

*       260         *       280         *       300
TrMDHd1 : AGTCTGAATCATCTTTCTTTGGCAACGAAACTAGTGCTGCTCTGCGTGCAACTTTTGCAC : 300
TrMDHd2 : AGTCTGAATCATCTTTCTTTGGCAACGAAACTAGTGCTGCTCTGCGTGCAACTTTTGCAC : 298
TrMDHd3 : AGTCTGAATCATCTTTCTTTGGCAACGAAACTGGTGCTGCTCTGCGTGCAACTTTTGCAC : 292

*       320         *       340         *       360
TrMDHd1 : CCAAAGCTCAAAAGGAAAAACCAAAACATCAACCGCAATTTGCATCCTCAGGCATCCTACA : 360
TrMDHd2 : CCAAAGCTCAAAAGGAAAAACCAAAACATCAACCGCAATTTGCATCCTCAGGCATCCTACA : 358
TrMDHd3 : CCAAAGCTCAAAAGGAAAAACCCAAACATCAACCGCAATTTGCAGCCTCAGGCATCCTACA : 352

*       380         *       400         *       420
TrMDHd1 : AAGTGGCGGTTCTTGGTGCTGCAGGAGGAATTGGTCAGCCACTGGCACTTCTCATTAAGA : 420
TrMDHd2 : AAGTGGCGGTTCTTGGTGCTGCAGGAGGAATTGGTCAGCCACTGGCACTTCTCATTAAGA : 418
TrMDHd3 : AAGTGGCGGTTCTCGGTGCTGCAGGAGGAATTGGTCAGCCACTGCACTTCTCATTAAGA : 412

*       440         *       460         *       480
TrMDHd1 : TGTCGCCTTTGGTTTCCGACCTGCATCTTTATGATATCGCGAATGTTAAGGGAGTTGCTG : 480
TrMDHd2 : TGTCGCCTTTGGTTTCCGACCTGCATCTTTATGATATCGCGAATGTTAAGGGAGTTGCTG : 478
TrMDHd3 : TGTCGCCTTTGGTTTCCGACCTGCATCTTTATGACATTGCGAATGTTAAGGGAGTTGCTG : 472

*       500         *       520         *       540
TrMDHd1 : CTGATATCAGTCATTGCAACACTCCTTCAAAGGTTTTGGATTTCACAGGTGCTTCTGAGT : 540
TrMDHd2 : CTGATATCAGTCATTGCAACACTCCTTCAAAGGTTTTGGATTTCACAGGTGCTTCTGAGT : 538
TrMDHd3 : CTGATATCAGCCATTGCAACACTCCTTCAAAGGTTTTGGATTTCACAGGTGCTTCTGAGC : 532

*       560         *       580         *
TrMDHd1 : TGGCAAATTGTTTG--------------------------------------------- : 554
TrMDHd2 : TGGCAAATTGTTTGAAAGGTGTGGATGTAGTTGTTATACCTGCTGGTGTTCCCAG--- : 593
TrMDHd3 : TAGCAAATTGTTTGAAAGGTGTGGATGTCGTTGTTATACCTGCTGGTGTTCCCAGAAA : 590
```

FIGURE 12

```
                      *         20         *         40         *         60
TrMDHe1  : TTNTNTTTATTTTATGTTTTTTNCCTCCTACATATAACTCTTNACTTNGCATACACTGTG :  60
TrMDHe2  : ---------------------------------------------------------GNG :   3
TrMDHe3  : ---------------------------------------------------------GTG :   3
TrMDHe4  : ------------------------------------------------------------ :   -
TrMDHe5  : ------------------------------------------------------------ :   -
TrMDHe6  : ------------------------------------------------------------ :   -
TrMDHe7  : ------------------------------------------------------------ :   -
TrMDHe8  : ------------------------------------------------------------ :   -
TrMDHe9  : ------------------------------------------------------------ :   -
TrMDHe10 : ------------------------------------------------------------ :   -

*         80         *        100         *        120
TrMDHe1  : TCTCT-AATTATTATTAGTCCTTCGAAATGGAAGCACATGCAGCTGGTACCAATCAGAGG : 119
TrMDHe2  : TCTCTCAATTATTATTAGTCCTTAGAAATGGAAGCACATGCAGCTGGGGCCAATCAGAGG :  63
TrMDHe3  : TCTCTCAATTATTATTAGTCCTTAGAAATGGAAGCCCATGCAGCTGGAGCCAATCAGAGG :  63
TrMDHe4  : -------------CNAGTCCTTANAAATGGAAGCACATGCAGCTGGAGCC-ATC-GAGG :  44
TrMDHe5  : ---------------------CAGAAATGGAAGCACATGCAGCTGGAGCCAATCAGAGG :  38
TrMDHe6  : ---------------------------------CCANTGCAGCTGGGGCCANTNNGAGG :  26
TrMDHe7  : ------------------------------------------------------------ :   -
TrMDHe8  : ------------------------------------------------------------ :   -
TrMDHe9  : ------------------------------------------------------------ :   -
TrMDHe10 : ------------------------------------------------------------ :   -

*        140         *        160         *        180
TrMDHe1  : ATTGCAAGAATCTCTGCTCATCTTCAGCCTCCAAATTTCCAGGAAGGAGGTGATGTTGCA : 179
TrMDHe2  : ATTGCAAGAATCTCTGCTCATCTTCAACCTCCAAATTTCCAGGAAGGAGGTGATGTTGCA : 123
TrMDHe3  : ATTGCAAGAATCTCTGCTCATCTTCAACCTCCAAATTTCCAGGAAGGAGGTGATGTTGCA : 123
TrMDHe4  : ATTGCAAGAATCTCTGCTCATCTTC-GCCTCCAAATTTCCAGGAAGGAGTGATGTGGCA : 103
TrMDHe5  : ATTGCAAGAATCTCTGCTCATCTTCAACCTCCAAATTTCCAGGAAGGAGGTGATGTTGCA :  98
TrMDHe6  : ATTGC-AGAATCTCTGCTCATCTT-NACCTCC-AATTTCCAGGAAGGAGGTGATGTTGCA :  83
TrMDHe7  : ------------------------------------------------------------ :   -
TrMDHe8  : ------------------------------------------------------------ :   -
TrMDHe9  : ------------------------------------------------------------ :   -
TrMDHe10 : ------------------------------------------------------------ :   -

*        200         *        220         *        240
TrMDHe1  : ATTAGCAAAGCTAACTGCAGAGCAAAAGGTGGGGCGCCGGGATTCAAAGTAGCAATCTTG : 239
TrMDHe2  : ATTAGCAAAGCTAACTGCAGAGCAAAAGGTGGGGCGCCGGGATTCAAAGTAGCAATCTTG : 183
TrMDHe3  : ATTAGCAAAGCTAACTGCAGAGCGAAAGGTGGGGCGCCGGGATTCAAAGTAGCAATCTTG : 183
TrMDHe4  : ATTAGCAAAGCTAACTGCAGAGCAAAAGGTGGGGCGCCGGGATTCAAAGTAGCAATCTTG : 163
TrMDHe5  : ATTAGCAAAGCTAACTGCAGAGCAAAAGGTGGGGCGCCGGGATTCAAAGTAGCAATCTTG : 158
TrMDHe6  : ATTAGCAAAGCTAACTGCAGAGCAAAAGGTGGGGCGCCGGGATTCAAAGTAGCAATCTTG : 143
TrMDHe7  : ------------------------------------------------------------ :   -
TrMDHe8  : ------------------------------------------------------------ :   -
TrMDHe9  : ------------------------------------------------------------ :   -
TrMDHe10 : ------------------------------------------------------------ :   -
```

FIGURE 13

```
                          *         260         *         280         *         300
TrMDHe1  : GGGGCTGCTGGTGGAATTGGTCAATCCCTTTCTTTGCTGTTGAAGATCAATCCATTGGTT : 299
TrMDHe2  : GGGGCTGCTGGTGGAATTGGTCAATCCCTTTCTTTGCTGTTGAAGATCAATCCATTGGTT : 243
TrMDHe3  : GGGGCTGCTGGTGGAATTGGTCAATCCCTTTCTTTGCTGTTGAAGATCAATCCATTGGTT : 243
TrMDHe4  : GGGGCTGCTGGTGGAATTGGTCAATCCCTTTCTTTGCTGTTGAAGATCAATCCATTGGTT : 223
TrMDHe5  : GGGGCTGCTGGTGGAATTGGTCAATCCCTTTCTTTGCTGTTGAAGATCAATCCATTGGTT : 218
TrMDHe6  : GGGGCTGCTGGTGGAATTGGTCAATCCCTTTCTTTGCTGTTGAAGATCAATCCATTGGTT : 203
TrMDHe7  : ------------------------------------------------------------ : -
TrMDHe8  : ------------------------------------------------------------ : -
TrMDHe9  : ------------------------------------------------------------ : -
TrMDHe10 : ------------------------------------------------------------ : -

*         320         *         340         *         360
TrMDHe1  : TCAGTTCTTCATCTTTATGATGTTGTCAACACTCCTGGTGTCACTGCTGATGTTAGTCAC : 359
TrMDHe2  : TCAGTTCTTCATCTTTATGATGTTGTCAACACTCCTGGTGTCACTGCTGATGTTAGTCAC : 303
TrMDHe3  : TCAGTTCTTCATCTTTATGATGTTGTCAACACTCCTGGTGTCACTGCTGATGTTAGTCAC : 303
TrMDHe4  : TCGGTTCTTCATCTTTATGATGTTGTCAACACTCCTGGTGTCACTGCTGATGTTAGTCAC : 283
TrMDHe5  : TCGGTTCTTCATCTTTATGATGTTGTCAACACTCCTGGTGTCACTGCTGATGTTAGTCAC : 278
TrMDHe6  : TCAGTTCTTCATCTTTATGATGTTGTCAACACTCCTGGTGTCACTGCTGATGTTAGTCAC : 263
TrMDHe7  : ------------------------------------------------------------ : -
TrMDHe8  : ------------------------------------------------------------ : -
TrMDHe9  : ------------------------------------------------------------ : -
TrMDHe10 : ------------------------------------------------------------ : -

*         380         *         400         *         420
TrMDHe1  : ATTGACACCGGTGCTGTGGTTCGTGGCTTTCTAGGGCAGGCACAACTTGAGAATGCACTT : 419
TrMDHe2  : ATTGACACCGGTGCTGTGGTTCGTGGCTTTCTAGGGCAGGCACAACTTGAGAATGCACTT : 363
TrMDHe3  : ATTGACACCGGTGCTGTGGTTCGTGGCTTTCTAGGGCAGGCACAACTTGAGAATGCACTT : 363
TrMDHe4  : ATTGACACCGGTGCTGTGGTTCGTGGCTTTCTAGGGCAGGCACAACTTGAGAATGCACTT : 343
TrMDHe5  : ATTGACACCGGTGCTGTGGTTCGTGGCTTTCTAGGGCAGGCACAACTTGAGAATGCACTT : 338
TrMDHe6  : ATTGACACCGGTGCTGTGGTTCGTGGCTTTCTAGGGCAGGCACAACTTGAGAATGCACTT : 323
TrMDHe7  : ----------------------------------GTTTCAACTTGAAAATGCACTT :  22
TrMDHe8  : ------------------------------------------------------------ : -
TrMDHe9  : ------------------------------------------------------------ : -
TrMDHe10 : ------------------------------------------------------------ : -

*         440         *         460         *         480
TrMDHe1  : ACAGGCATGGACTTGGTCGTTATACCTGCTGGTGTGCCGAGGAAACCTGGAATGACAAGG : 479
TrMDHe2  : ACAGGCATGGACTTGGTCGTTATACCTGCTGGTGTGCCGAGGAAACCTGGAATGACAAGG : 423
TrMDHe3  : ACAGGCATGGACTTGGTCGTTATACCTGCTGGTGTGCCGAGGAAACCTGGAATGACAAGG : 423
TrMDHe4  : ACAGGCATGGACTTGGCCGTTATACCTGCTGGTGTGCCGAGGAAACCTGGAATGACAAGG : 403
TrMDHe5  : ACAGGCATGGACTTGGTCGTTATACCTGCTGGTGTGCCGAGGAAACCTGGAATGACAAGG : 398
TrMDHe6  : ACAGGCATGGACTTGGTCGTTATACCTGCTGGTGTGCCGAGGAAACCTGGAATGACAAGG : 383
TrMDHe7  : ACAGGCATGGACTTGGTCGNTATACCTGCTGGTGTGCCGAGGAAACCTGGAATGACAAGG :  82
TrMDHe8  : ------------------------------------------------------------ : -
TrMDHe9  : ------------------------------------------------------------ : -
TrMDHe10 : ------------------------------------------------------------ : -

*         500         *         520         *         540
TrMDHe1  : GATGACTTATTTAAGATAAATGCTGGAATTGTGAGGACTCTTAGCGAAGGAATTGCCAAG : 539
TrMDHe2  : GATGACTTATTTAAGATAAATGCTGGAATTGTGAGGACTCTTAGCGAAGGAATTGCCAAG : 483
TrMDHe3  : GATGACTTATTTAAGATAAATGCTGGAATTGTGAGGACTCTTTCTGAAGGAATTGCCAAG : 483
TrMDHe4  : GATGACTTATTTAAGATAAATGCTGGAATTGTGAGGACTCTTTCTGAAGGAATTGCCAAG : 463
TrMDHe5  : GATGACTTATTTAAGATAAATGCTGGAATTGTGAGGACTCTTTCTGAAGGAATTGCCAAG : 458
TrMDHe6  : GATGACTTATTTAAGATAAATGCTGGAATTGTGAGGACTCTTAGCGAAGGAATTGCCAAG : 443
TrMDHe7  : GATGACTTATTTAAGATAAATGCTGGAATTGTGAGGACTCTTAGCGAAGGAATTGCCAAG : 142
TrMDHe8  : ------------------------------------------------------------ : -
TrMDHe9  : ------------------------------------------------------------ : -
TrMDHe10 : ------------------------------------------------------------ : -
```

FIGURE 13 (cont.)

```
                         *         560         *         580         *         600
TrMDHe1  : AGCTGTCCTAATGCAATTGTCAACTTGATTAGCAATCCAGTGAATTCCACTGTGCCAATT : 599
TrMDHe2  : AGCTGTCCTAATGCAATTGTCAACTTGATTAGCAATCCAGTGAATTCCACTGTGCCAATT : 543
TrMDHe3  : AGCTGTCCTAATGCAATTGTCAACTTGATTAGCAATCCAGTGAATTCCACTGTGCCAATT : 543
TrMDHe4  : AGCTGTCCTAATGCAATTGTCAACTTGATTAGCAATCCAGTGAATTCCACTGTGCCAATT : 523
TrMDHe5  : AGCTGTCCTAATGCAATTGTCAACTTGATTAGCAATCCAGTGAATTCCACTGTGCCAATT : 518
TrMDHe6  : AGCTGTCCTAATGCAATTGTCAACTTGATTAGCAATCCAGTGAATTCCACTGTGCCAATT : 503
TrMDHe7  : AGCTGTCCTAATGCAATTGTCAACTTGATTAGCAATCCAGTGAATTCCACTGTGCCAATT : 202
TrMDHe8  : ------------------------------------------------------------ : -
TrMDHe9  : ------------------------------------------------------------ : -
TrMDHe10 : ------------------------------------------------------------ : -

*         620         *         640         *         660
TrMDHe1  : GCTGCTGAGGTTTTCAAGAAAGCCGGTACATATGATCCAAAGCGACTTTTANGGGTAACA : 659
TrMDHe2  : GCTGCTGAGGTTTTCAAGAAAGCCGGTACAT----------------------------- : 574
TrMDHe3  : GCTGCTGAGGTCTTCAAGAAAGCCGGTACATAT--------------------------- : 576
TrMDHe4  : GCTGCTGAGGTCTTCAAGAAAGCCGGTACATATGATCCAAAACGACTTTTAGGAGTTACA : 583
TrMDHe5  : GCTGGTGAGGTCTTCAAGAAAGCCGNACATATGATCCAAAACNACTTTTAAGGGTTACA  : 578
TrMDHe6  : GCTGCTGAGGTTTTCAAGAAAGCCGGTACATATGATCCAAAGCGACTTTTAG-------- : 555
TrMDHe7  : GCTGCTGAGGTTTTCAAGAAAGCCGGTACATATGATTCAAAGCGACTTTTAGGGGTAACA : 262
TrMDHe8  : ---------------------------------TATGATCC-AGCGACTTTTAGG-GGTACA : 28
TrMDHe9  : ------------------------------------------------------------ : -
TrMDHe10 : ------------------------------------------------------------ : -

*         680         *         700         *         720
TrMDHe1  : ACCCTCGATGNTGT---------------------------------------------- : 673
TrMDHe2  : ------------------------------------------------------------ : -
TrMDHe3  : ------------------------------------------------------------ : -
TrMDHe4  : ACCCTCGATG-------------------------------------------------- : 593
TrMDHe5  : ACCCTNGATGTTGNGAGGGCAAATACTTTTGTGGCANAAG-NCTTGGNGTTGANCCAAA  : 637
TrMDHe6  : ------------------------------------------------------------ : -
TrMDHe7  : ACCCTCGATGTTGTGAGGGCAAATACCTTTGTGGCAGAAGTACTTGGTGTTGATCCAAGA : 322
TrMDHe8  : ACCCTCGATGTTGTGAGGGCAAATACCTTTGTGGCAGAAGTACTTGGTGTTGATCCAAGA : 88
TrMDHe9  : ------------------------------------------------------------ : -
TrMDHe10 : ------------------------------------------------------------ : -

*         740         *         760         *         780
TrMDHe1  : ------------------------------------------------------------ : -
TrMDHe2  : ------------------------------------------------------------ : -
TrMDHe3  : ------------------------------------------------------------ : -
TrMDHe4  : ------------------------------------------------------------ : -
TrMDHe5  : NAGGCTNATNTTCCANTGGTAGGAGGGCCCCNGGANT-ACAANATTACC-CTTTTTT--  : 693
TrMDHe6  : ------------------------------------------------------------ : -
TrMDHe7  : GAGGTTGATGTTCCAGNGGTAGGATGGCACGCANGAGT-ACAATATTACCTCTTTTGTCA : 381
TrMDHe8  : GAGGTTGATGTTCCAGTGGTAGGAGGGCACGCAGGAGTCACAATATTACCTCTTTTGTCA : 148
TrMDHe9  : ------------------------------------------------------------ : -
TrMDHe10 : ------------------------------------------------------------ : -

*         800         *         820         *         840
TrMDHe1  : ------------------------------------------------------------ : -
TrMDHe2  : ------------------------------------------------------------ : -
TrMDHe3  : ------------------------------------------------------------ : -
TrMDHe4  : ------------------------------------------------------------ : -
TrMDHe5  : ------------------------------------------------------------ : -
TrMDHe6  : ------------------------------------------------------------ : -
TrMDHe7  : CAGGTTAAGCCTNCCAGTANCTT-ACCGNAGAANAAACCGAATACCTGACANANCGNATT : 440
TrMDHe8  : CAGGTTAAGCCTCCCAGTAGCTTCACTGCAGAAGAAACCGAATACCTGACAAATCGCATT : 208
TrMDHe9  : ------------------------------------------------------------ : -
TrMDHe10 : ------------------------------------------------------------ : -
```

FIGURE 13 (cont.)

```
                    *        860         *         880        *         900
TrMDHe1   : ------------------------------------------------------------ :   -
TrMDHe2   : ------------------------------------------------------------ :   -
TrMDHe3   : ------------------------------------------------------------ :   -
TrMDHe4   : ------------------------------------------------------------ :   -
TrMDHe5   : ------------------------------------------------------------ :   -
TrMDHe6   : ------------------------------------------------------------ :   -
TrMDHe7   : CAAAANGGCGGAACACAAGTCGTTGAGGCAAAG--------------------------- : 473
TrMDHe8   : CAAAAGGCGGAACACAAGTTGTTGAGGCAAAGGCTGGGGCTGGTTCGGCAACACTANTA : 268
TrMDHe9   : -----------------GTTGTTGAGGCAAAGGCTGGGGCTGGTTCGGCAACACTANTN :  42
TrMDHe10  : --------------------TTGTTGAGGNAAAGGCTGGGGCTGGTTCGC-NAC-CT-NTN :  38

*        920         *         940        *         960
TrMDHe1   : ------------------------------------------------------------ :   -
TrMDHe2   : ------------------------------------------------------------ :   -
TrMDHe3   : ------------------------------------------------------------ :   -
TrMDHe4   : ------------------------------------------------------------ :   -
TrMDHe5   : ------------------------------------------------------------ :   -
TrMDHe6   : ------------------------------------------------------------ :   -
TrMDHe7   : ------------------------------------------------------------ :   -
TrMDHe8   : ATGGCATATGCAGCTGCCAAGTTTGCTAACGCATGCCTCCGTGGCTTGAAAGGAGAAGCC : 328
TrMDHe9   : ATGGCCTATGCAGCTGCCAAGTTTGCTAACGCATGCCTCCGTGGCTTGAAAGGAGAAGCC : 102
TrMDHe10  : ATGGCCTATGCAGCTGCC-AGTTTGCTAACGCATGCCTCCGTGGCTTGAAAGGAGAAGCC :  97

*        980         *        1000        *        1020
TrMDHe1   : ------------------------------------------------------------ :   -
TrMDHe2   : ------------------------------------------------------------ :   -
TrMDHe3   : ------------------------------------------------------------ :   -
TrMDHe4   : ------------------------------------------------------------ :   -
TrMDHe5   : ------------------------------------------------------------ :   -
TrMDHe6   : ------------------------------------------------------------ :   -
TrMDHe7   : ------------------------------------------------------------ :   -
TrMDHe8   : GGGATAGTGGAGTGTGCTTTTGTTGATTCTCAGGTTACGGAACTTCCTTTCTTTGCAGCC : 388
TrMDHe9   : GGGATAGTGGAGTGTGCTTTTGTTGATTCTCAGGTTACGGAACTTCCTTTCTTTGCAGCC : 162
TrMDHe10  : GGGATAGTGGAGTGTGCTTTTGTTGATTCTCAGGTTACGGAACTTCCTTTCTTTGCAGCC : 157

*       1040         *        1060        *        1080
TrMDHe1   : ------------------------------------------------------------ :   -
TrMDHe2   : ------------------------------------------------------------ :   -
TrMDHe3   : ------------------------------------------------------------ :   -
TrMDHe4   : ------------------------------------------------------------ :   -
TrMDHe5   : ------------------------------------------------------------ :   -
TrMDHe6   : ------------------------------------------------------------ :   -
TrMDHe7   : ------------------------------------------------------------ :   -
TrMDHe8   : AAGGTTCGTCTTGGTCGCGGTGGAGCAGAAGAGATATACCAACTTGGTCCCCTTAATGAG : 448
TrMDHe9   : AAGGTTCGTCTTGGTCGCGGTGGAGCAGAAGAGATATATCAACTTGGTCCCCTTAATGAG : 222
TrMDHe10  : AAGGTTCGTCTTGGTCGCGGTGGAGCAGAAGAGATATATCAACTTGGTCCCCTTAATGAG : 217

*       1100         *        1120        *        1140
TrMDHe1   : ------------------------------------------------------------ :   -
TrMDHe2   : ------------------------------------------------------------ :   -
TrMDHe3   : ------------------------------------------------------------ :   -
TrMDHe4   : ------------------------------------------------------------ :   -
TrMDHe5   : ------------------------------------------------------------ :   -
TrMDHe6   : ------------------------------------------------------------ :   -
TrMDHe7   : ------------------------------------------------------------ :   -
TrMDHe8   : TATGAGAGGATTGGCTTGGAAAAAGCGAAGAATGAGTTAGCCGGAAGCATCCAGAAGGGA : 508
TrMDHe9   : TATGAGAGGATTGGATTAGAAAAAGCGAAGAAGGAGTTAGCAGGAAGCATCCAGAAGGGA : 282
TrMDHe10  : TATGAGAGGATTGGATTAGAAAAAGCGAAGAAAGAGTTAGCAGGAAGCATCCAGAAGGGA : 277
```

FIGURE 13 (cont.)

```
                    *         1160        *         1180        *         1200
TrMDHe1  : ------------------------------------------------------------ : -
TrMDHe2  : ------------------------------------------------------------ : -
TrMDHe3  : ------------------------------------------------------------ : -
TrMDHe4  : ------------------------------------------------------------ : -
TrMDHe5  : ------------------------------------------------------------ : -
TrMDHe6  : ------------------------------------------------------------ : -
TrMDHe7  : ------------------------------------------------------------ : -
TrMDHe8  : GTAGAATTCATCAAAAATAAGTCAGATAAGGAAAAATTAGTTTTGTATTGNCTCTTTCT : 568
TrMDHe9  : GTAGAATTCATCACANAAAAANAA------------------------------------ : 306
TrMDHe10 : GTAGAATTCATCAAAAAAAAAN-------------------------------------- : 299

*         1220        *
TrMDHe1  : ------------------------------ : -
TrMDHe2  : ------------------------------ : -
TrMDHe3  : ------------------------------ : -
TrMDHe4  : ------------------------------ : -
TrMDHe5  : ------------------------------ : -
TrMDHe6  : ------------------------------ : -
TrMDHe7  : ------------------------------ : -
TrMDHe8  : ATATCTATAAAGAACTTGTGTAATAATTCC : 598
TrMDHe9  : ------------------------------ : -
TrMDHe10 : ------------------------------ : -
```

FIGURE 13 (cont.)

```
                  *        20         *        40         *        60
TrMDHf1 : GNNTACNGCTATCNACCCTTCTTTCTTATACAATAATNATAGATAAATTCATCTGCTAAA : 60
TrMDHf2 : ------------------------------------------------------------ : -
TrMDHf3 : ------------------------------------------------------------ : -

*        80         *       100         *       120
TrMDHf1 : TTATGGAGCCAAATTCAGATGCAAATCAACGAATCGCAAGAATCTCCGGCCACCTAAATC : 120
TrMDHf2 : ------------------------------------------------------------ : -
TrMDHf3 : ------------------------------------------------------------ : -

*       140         *       160         *       180
TrMDHf1 : CTCCCAATTTCAAGATGAATGAACATGGTGATTCTTCTTTGACAAGTTTCCATTGCCGTG : 180
TrMDHf2 : ------------------------------------------------------------ : -
TrMDHf3 : ------------------------------------------------------------ : -

*       200         *       220         *       240
TrMDHf1 : CAAAAGGTGGAGCACCTGGATTCAAAGTTGCAATTTTAGGTGCTGCTGGTGGCATAGGTC : 240
TrMDHf2 : ------------------------------------------------GTGNCATAGGTN : 12
TrMDHf3 : ------------------------------------------------------------ : -

*       260         *       280         *       300
TrMDHf1 : AACCTCTTTCAATGTTGATGAAGATGAATCCNTTGGTTT-AGTTCTTCATCTTTATGATG : 299
TrMDHf2 : ANCCTCTTT-NATGTTGATGAAGATGAATCCTTGGTTT-AGTTCTTCATCTTTATGATG : 70
TrMDHf3 : ---------------------TTTGGTTTNNGTTCTTATNCTTTATGATG : 29

*       320         *       340         *       360
TrMDHf1 : TTGTTAATACTCCTGGTGTTACTTCTGATATTAGTCANATGGATACTGNTGCTGTTGTTC : 359
TrMDHf2 : TTGTTAATACTCCTGGTGTTACTTCTGATATTAGTCATATGGATACTGCTGCTGTTGTTC : 130
TrMDHf3 : TTG-TAATACTCCTGGTG-TACTTCTGATATTAGT-ATATGGATACTGCTGCTGTTGTTC : 86

*       380         *       400         *       420
TrMDHf1 : GAGGATTTTTGGGGCAAAATCAGCTTGAGGATGCACTTACAGGTATGGATTTGGTAATCA : 419
TrMDHf2 : GAGGGTTTTTGGGGCAAAATCAGCTTGAGGATGCACTTACAGGTATGGATTTGGTAATCA : 190
TrMDHf3 : GAGGGTTTTTGGGGCAAAATCAGCTTGAGGATGCACTTACAGGTATGGATTTGGTAATCA : 146

*       440         *       460         *       480
TrMDHf1 : TTCCTGCNGGTGTTCCCCGTAAACCTGGAATGACAAGAGATGATCTCTTCAATATAAATG : 479
TrMDHf2 : TTCCTGCCGGTGTTCCCCGTAAACCTGGAATGACAAGAGATGATCTCTTCAATATAAATG : 250
TrMDHf3 : TTCCTGCCGGTGTTCCCCGTAAACCTGGAATGACAAGAGATGATCTCTTCAATATAAATG : 206

*       500         *       520         *       540
TrMDHf1 : CCGGGATCGTTAAAACACTCTGTGAAGCAATTGCNAAGCGATGTCCTAAGGCGATTGTCA : 539
TrMDHf2 : CCGGGATCGTTAAAACACTCTGTGAAGCAATTGCAAAGCGATGTCCTAAGGCGATTGTCA : 310
TrMDHf3 : CCGGGATCGTTAAAACACTCTGTGAAGCAATTGCAAAGCGATGTCCTAAGGCGNTTGTCA : 266

*       560         *       580         *       600
TrMDHf1 : ACGTGATTAGTAATCCGGTTAACTCCACTGTCC--------------------------- : 572
TrMDHf2 : ACGTGATTAGTAATCCGGTTAACTCCACTGTCCCCATTGCGGCTGAAGTTTTCAAAAGAG : 370
TrMDHf3 : ACGTGATTAGTAATCCGGTTAACTCCACTGTCCCCATTGCGGCTGAAGTTTTCAAAAGAG : 326
```

FIGURE 14

```
              *         620         *         640         *         660
TrMDHf1 : ------------------------------------------------------------ : -
TrMDHf2 : CCGGTACTTATGATCCCAAGAGACTTTTGGGAGTGACAATGCTTGATGTGGTTCGGGCCA : 430
TrMDHf3 : CCGGTACTTATGATCCCAAGAGACTTTTGGGAGTGACAATGCTTGATGTGGTTCGGGCCA.: 386

*         680         *         700         *         720
TrMDHf1 : ------------------------------------------------------------ : -
TrMDHf2 : ATACGTTTGTGGCTGAAGTTCTTGGTCTTGATCCAAGGGATGTGGATGTCCCAGTTGTCG : 490
TrMDHf3 : ATACGTTTGTGGCTGAAGTTCTTGGTCTTGATCCAAGGGATGTGGATGTCCCAGTTGTCG : 446

*         740         *         760         *         780
TrMDHf1 : ------------------------------------------------------------ : -
TrMDHf2 : GAGGACATGCCGGAATCACCATTTTACCTCTGCTTTCTCAGGTTAAACCACATTCCTCTT : 550
TrMDHf3 : GAGGACATGCCGGAATCACCATTTTACCTCTGCTTTCTCAGGTTAAACCACATTCCTCTT : 506

*         800         *         820         *         840
TrMDHf1 : ------------------------------------------------------------ : -
TrMDHf2 : TCACGACAAAGGAAATTGAGTACTTG---------------------------------- : 576
TrMDHf3 : TCACGACAAAGGAAATTGAGTACTTGACAGATCGCATACAAAACGGTGGAACTGAAGTTG : 566

*         860
TrMDHf1 : --------------------------- : -
TrMDHf2 : --------------------------- : -
TrMDHf3 : TTGAGGCCAAAGCTGGAGCTGGCTCT  : 592
```

FIGURE 14 (cont.)

```
             *         20         *         40         *         60
TrMDHg1 : GTAGGCATCA--TAACAGCACAATGAACATGGAAATGTTTGCTTTGGAAATTATGGACAATA :  60
TrMDHg2 : ----GNNCGATCTAACAG-ACAATGAACATGGAAATGTTTGCTTTGGAAATTATGGACAATA :  57

*         80         *        100         *        120
TrMDHg1 : CGGTCCTTAAAAAATCTGTTCTTGTTTTATTTTGTACTTTTTTGTTTTGGAAGATCGTTAGA : 122
TrMDHg2 : CGGTCCTTAAAAAATCTGTTCTTGTTTTATTTTGTACTTTTTTGTTTTGGAAGATCGTTAGA : 119

*        140         *        160         *        180
TrMDHg1 : TACATGTGTGGTCTTCTCAAAGTTGATAAGGAACCAGTCACTGTATTGGTCACTGGTGCTGC : 184
TrMDHg2 : TACATGTGTGGTCTTCTCAAAGTTGATAAGGAACCAGTCACTGTATTGGTCACTGGTGCTGC : 181

*        200         *        220         *        240
TrMDHg1 : AGGACAAATTGGNTATGCTCTTGNTNCAATGATTGCNANAGGGATGATGCTANGNCCAAATC : 246
TrMDHg2 : AGGACAAATTGGTTATGCTCTTGTTCCAATGATTGCAAGAGGGATGATGCTAGGCCCAAATC : 243

*        260         *        280         *        300         *
TrMDHg1 : NACCTGGNATTGTTGATATGCTNGNTNTTG-------------------------------- : 276
TrMDHg2 : AACCTGCAATTCTTCATATGCTTGATATTGAACCAGGATTAGAGGCCCTTAAAGGGGTGAAG : 305

320         *        340         *        360         *
TrMDHg1 : -------------------------------------------------------------- :   -
TrMDHg2 : ATGGAACTGATTGATGGTGCTTTCCCACTTCTTAGAGGTGTTGTTGCTACTACGGATGTTGT : 367

380         *        400         *        420         *
TrMDHg1 : -------------------------------------------------------------- :   -
TrMDHg2 : TGAAGCATGCAAGGATGTTAACATTGCTGTTATGCTTGGTGGATCCCCAAGGAAGGAAGGAA : 429

440         *        460         *        480         *
TrMDHg1 : -------------------------------------------------------------- :   -
TrMDHg2 : TGGAAAGAAAAGATGTAATGTCTAAGAATGTTTCAATTTACAAGGCTCAAGCTTCAGCTTTG : 491

500         *        520         *        540         *      5
TrMDHg1 : -------------------------------------------------------------- :   -
TrMDHg2 : GAGGAGCATGCTGCTGCAGATTGTAAAGTGCTAGTGGTAGCCAATCCAGCAAACACAAATGC : 553

60         *        580         *
TrMDHg1 : -------------------------------------------   :   -
TrMDHg2 : TCTAATATTGAAAGAATTTGCTCCATCAATCCCTGAGAAAA       : 594
```

FIGURE 15

```
              *         20         *         40         *         60
TrMDHh1 : GNNTACNGCTATCNACCCTTCTTTCTTATACAATAATNATAGATAAATTCATCTGCTAAA : 60
TrMDHh2 : ------------------------------------------------------------ :  -
TrMDHh3 : ------------------------------------------------------------ :  -

*         80         *        100         *        120
TrMDHh1 : TTATGGAGCCAAATTCAGATGCAAATCAACGAATCGCAAGAATCTCCGGCCACCTAAATC : 120
TrMDHh2 : ------------------------------------------------------------ :  -
TrMDHh3 : ------------------------------------------------------------ :  -

*        140         *        160         *        180
TrMDHh1 : CTCCCAATTTCAAGATGAATGAACATGGTGATTCTTCTTTGACAAGTTTCCATTGCCGTG : 180
TrMDHh2 : ------------------------------------------------------------ :  -
TrMDHh3 : ------------------------------------------------------------ :  -

*        200         *        220         *        240
TrMDHh1 : CAAAAGGTGGAGCACCTGGATTCAAAGTTGCAATTTTAGGTGCTGCTGGTGGCATAGGTC : 240
TrMDHh2 : ---------------------------------------------GTGNCATAGGTN    :  12
TrMDHh3 : ------------------------------------------------------------ :  -

*        260         *        280         *        300
TrMDHh1 : AACCTCTTTCAATGTTGATGAAGATGAATCCNTTGGTTT-AGTTCTTCATCTTTATGATG : 299
TrMDHh2 : ANCCTCTTT-NATGTTGATGAAGATGAATCCTNTGGTTT-AGTTCTTCATCTTTATGATG :  70
TrMDHh3 : ----------------------------TTTGGTTTNNGTTCTTANNCTTTATGATG    :  29

*        320         *        340         *        360
TrMDHh1 : TTGTTAATACTCCTGGTGTTACTTCTGATATTAGTCANATGGATACTGNTGCTGTTGTTC : 359
TrMDHh2 : TTGTTAATACTCCTGGTGTTACTTCTGATATTAGTCATATGGATACTGCTGCTGTTGTTC : 130
TrMDHh3 : TTG-TAATACTCCTGGTG-TACTTCTGATATTAGT-ATATGGATACTGCTGCTGTTGTTC :  86

*        380         *        400         *        420
TrMDHh1 : GAGGNTTTTTGGGGCAAAATCAGCTTGAGGATGCACTTACAGGTATGGATTTGGTAATCA : 419
TrMDHh2 : GAGGGTTTTTGGGGCAAAATCAGCTTGAGGATGCACTTACAGGTATGGATTTGGTAATCA : 190
TrMDHh3 : GAGGGTTTTTGGGGCAAAATCAGCTTGAGGATGCACTTACAGGTATGGATTTGGTAATCA : 146

*        440         *        460         *        480
TrMDHh1 : TTCCTGCNGGTGTTCCCCGTAAACCTGGAATGACAAGAGATGATCTCTTCAATATAAATG : 479
TrMDHh2 : TTCCTGCCGGTGTTCCCCGTAAACCTGGAATGACAAGAGATGATCTCTTCAATATAAATG : 250
TrMDHh3 : TTCCTGCCGGTGTTCCCCGTAAACCTGGAATGACAAGAGATGATCTCTTCAATATAAATG : 206

*        500         *        520         *        540
TrMDHh1 : CCGGGATCGTTAAAACACTCTGTGAAGCAATTGCNAAGCGATGTCCTAAGGCGATTGTCA : 539
TrMDHh2 : CCGGGATCGTTAAAACACTCTGTGAAGCAATTGCAAAGCGATGTCCTAAGGCGATTGTCA : 310
TrMDHh3 : CCGGGATCGTTAAAACACTCTGTGAAGCAATTGCAAAGCGATGTCCTAAGGCGNTTGTCA : 266

*        560         *        580         *        600
TrMDHh1 : ACGTGATTAGTAATCCGGTTAACTCCACTGTCC--------------------------- : 572
TrMDHh2 : ACGTGATTAGTAATCCGGTTAACTCCACTGTCCCCATTGCGGCTGAAGTTTTCAAAAGAG : 370
TrMDHh3 : ACGTGATTAGTAATCCGGTTAACTCCACTGTCCCCATTGCGGCTGAAGTTTTCAAAAGAG : 326
```

FIGURE 16

```
                    *        620         *        640         *        660
TrMDHh1 : ------------------------------------------------------------ :   -
TrMDHh2 : CCGGTACTTATGATCCCAAGAGACTTTTGGGAGTGACAATGCTTGATGTGGTTCGGGCCA : 430
TrMDHh3 : CCGGTACTTATGATCCCAAGAGACTTTTGGGAGTGACAATGCTTGATGTGGTTCGGGCCA : 386

*        680         *        700         *        720
TrMDHh1 : ------------------------------------------------------------ :   -
TrMDHh2 : ATACGTTTGTGGCTGAAGTTCTTGGTCTTGATCCAAGGGATGTGGATGTCCCAGTTGTCG : 490
TrMDHh3 : ATACGTTTGTGGCTGAAGTTCTTGGTCTTGATCCAAGGGATGTGGATGTCCCAGTTGTCG : 446

*        740         *        760         *        780
TrMDHh1 : ------------------------------------------------------------ :   -
TrMDHh2 : GAGGACATGCCGGAATCACCATTTTACCTCTGCTTTCTCAGGTTAAACCACATTCCTCTT : 550
TrMDHh3 : GAGGACATGCCGGAATCACCATTTTACCTCTGCTTTCTCAGGTTAAACCACATTCCTCTT : 506

*        800         *        820         *        840
TrMDHh1 : ------------------------------------------------------------ :   -
TrMDHh2 : TCACGACAAAGGAAATTGAGTACTTG---------------------------------  : 576
TrMDHh3 : TCACGACAAAGGAAATTGAGTACTTGACAGATCGCATACAAAACGGTGGAACTGAAGTTG : 566

*        860
TrMDHh1 : ------------------------  :   -
TrMDHh2 : ------------------------  :   -
TrMDHh3 : TTGAGGCCAAAGCTGGAGCTGGCTCT : 592
```

FIGURE 16 (cont.)

```
              *         20         *         40         *         60
TrMDHi1 : GNAATCCTCTTTGNCTCCCCTACCCTCCTTTTTTTTCCTTCCTTCTTACA-CTTCTCTTCT :  60
TrMDHi2 : ----------------------------------------TTCTTACACCTTCTCTTAT :  19

*         80         *        100         *        120
TrMDHi1 : CAACTTTCCACCTCTGAACAAAACTTCTATCTTTTCTCATTTTCTTATACCCTTTTACAAA : 121
TrMDHi2 : -AACTTTCAACCTCTGAACCAAA-TT-AATCTTTTCT-ATTTTCTTATACCCTTTTACAAA :  76

*        140         *        160         *        180
TrMDHi1 : CTTCTTCATAAAGTGTTATTT--TTTTTTATTACTCTTTTCAAGAAACACAAAAACAGTGT : 180
TrMDHi2 : CTTCTTCATAAAGTGTTTGGTTTTTTTTTTATTACTCTTTTCAAGAACCACAAAAACAGTGT : 137

*        200         *        220         *        240
TrMDHi1 : TTCTTGAATTCTTTGAAATTTTTTTTTTCCTGCAACCATGGCCTTGGCACAGTTAAACAAT : 241
TrMDHi2 : TTCTTGAATTC-TTGGAA-TTTTTTTTTCCTGCAACCATGGCTTTGGCACACTTAAACAAC : 196

*        260         *        280         *        300
TrMDHi1 : CCCACTTGCTCAAAAACTCAACTTCACTCATCACAACTCTCATTTTTGTCTAGGACTCTCC : 302
TrMDHi2 : CCCACTTGCTCAAAAACTCAACTTCATTCATCACAGCTCTCATTTCTCTCTAGGACTCTCC : 257

*        320         *        340         *        360
TrMDHi1 : CTAGGCAATATCACTGTACTTTTGCACCACTTCACAGAACTCAACATGGCAGAATTACTTG : 363
TrMDHi2 : CTAGGCAATATCACTGTACTTTTGCACCACTTCACAGAACTCAACATGGCAGAATTACTTG : 318

*        380         *        400         *        420
TrMDHi1 : TTCTGTTGCACCAAATCAAGTGCAGGCTCCAGCTGTACAATCACAGGATCCCAAGAATAAG : 424
TrMDHi2 : TTCTGTTGCACCAAATCAAGTGCAGGCTCCAGCTGTACAATCACAGGATCCCAAGAATAAG : 379

*        440         *        460         *        480
TrMDHi1 : CCTGATTGCTATGGTGTCTTCTGCCTTACCTATGATTTGAAGGCTGAAGAGGAGACAAAAT : 485
TrMDHi2 : CCTGATTGCTATGGTGTCTTCTGCCTTACCTATGATTTGAAGGCTGAAGAGGAGACAAAAT : 440

*        500         *        520         *        540
TrMDHi1 : CCTGGAAGAAATTAATCAACATTGCAGTCTCAGGTGCTGCTGGAATGATTTCCAATCATCT : 546
TrMDHi2 : CCTGGAAGAAATTAATCAACATTGCAGTCTCAGGTGCTGCTGGAATGATTTCCAATCATCT : 501

*        560         *        580         *        600         *
TrMDHi1 : ACTTTTCAAGCTTGCATCTGGTGAAGTTTTTGGCCCAAATCAACCTATTGCGCTGA----- : 602
TrMDHi2 : ACTTTTCAAGCTTGCATCTGGTGAAGTTTTTGGCCCAAATCAACCTATTGCGCTGAAATTA : 562

620         *        640
TrMDHi1 : --------------------------------------- :   -
TrMDHi2 : TTAGGATCAGAAAGGTCCTTCCAAGCTCTTGAAGGTG    : 599
```

FIGURE 17

```
              *        20         *        40         *        60
TrPEPCa1 : GNNACATTNCCGAATGCTGCTGAACTAGGGAGTGATTCCCTTGGAGCCTATGTCATCTCT :  60
TrPEPCa2 : ------------------------------------------------------------ :   -
TrPEPCa3 : ------------------------------------------------------------ :   -

*        80         *       100         *       120
TrPEPCa1 : ATGGCCTCAAGTGCAAGCGATGTCCTTGCAGTAGAGCTTTT-CAGAAGGATGCACGACTT : 119
TrPEPCa2 : -----------------------------------GNACTTTTACAGAAGGATGCACGTCTT :  27
TrPEPCa3 : ------------------------------------AGCTTTTACAGANGGATGCACGTCTT :  26

*       140         *       160         *       180
TrPEPCa1 : GCTGCTATTGGAGACTTCGGAAGAGCATGTCCTGGTGGAACGTTGCGGGTTGTCCCTCTA : 179
TrPEPCa2 : ACAGTTTGTGGAGAATTAGGAAGAGCATGTCCGGGTGGAACGCTTCGGGTGGTTCCTCTA :  87
TrPEPCa3 : ACAGTTTGTGGAGAATTAGGAAGAGCATGTCCGGGTGGAACGCTTCGGGTGGTTCCTCTA :  86

*       200         *       220         *       240
TrPEPCa1 : TTTGAAACTGTGAAGGACCTAAGAGGAGCTGGTTCAGTTATCGGAAACTTTTATCGATA : 239
TrPEPCa2 : TTTGAAACTGTGCAAGACCTGAGAGGAGCTGGTGCAGTTATCAGAAAACTTTTATCAATC : 147
TrPEPCa3 : TTTGAAACTGTGCAAGACCTGAGAGGAGCTGGTGCAGTTATCAGAAAACTTTTATCAATC : 146

*       260         *       280         *       300
TrPEPCa1 : GACTGGTACCGTGAACACATCATTAAGAACCACAATGGACATCAAGAGGTTATGGTTGGA : 299
TrPEPCa2 : GATTGGTACCGCCAACACATCATTAAGAACCATAACGGACACCAAGAGGTTATGGTCGGT : 207
TrPEPCa3 : GATTGGTACCGCCAACACATCATTAAGAACCATAACGGACACCAAGAGGTTATGGTCGGT : 206

*       320         *       340         *       360
TrPEPCa1 : TATTCTGATTCGGGTAAAGATGCTGGCCGCTTCACTGCTGCTTGGGAACTTTACAAAGCT : 359
TrPEPCa2 : TATTCTGATTCTGGTAAAGATGCCGGGCGCTTTACTGCTGCTTGGGAACTTTACAAAGCT : 267
TrPEPCa3 : TATTCTGATTCTGGTAAAGATGCCGGGCGCTTTACTGCTGCTTGGGAACTTTACAAAGCT : 266

*       380         *       400         *       420
TrPEPCa1 : CAGGAGGATGTTGTAGCTGCTTGCAATGATTATGGTATTAAAGTTACACTGTTTCATGGC : 419
TrPEPCa2 : CAAGAGGATGTAGTGGCTGCTTGCAATAAGTACGATACTAAGGTTACTTTGTTCCACGGC : 327
TrPEPCa3 : CAAGAGGATGTAGTGGCTGCTTGCAATAAGTACGATACTAAGGTTACTTTGTTCCACGGC : 326

*       440         *       460         *       480
TrPEPCa1 : CGTGGAGGCAGTATTGGTCGAGGTGGTGGCCCTACATATCTGGCTATTCAGTCCCAACCA : 479
TrPEPCa2 : CGCGGAGGGAGTATTGGACGTGGCGGAGGCCCAACATATCTGGCTATTCAGTCCCAGCCA : 387
TrPEPCa3 : CGCGGAGGGAGTATTGGACGTGGCGGAGGCCCAACATATCTGGCTATTCAGTCCCAGCCA : 386

*       500         *       520         *       540
TrPEPCa1 : CCTGGCTCTGTGATGGGAACACTTCGGTCTACTGAGCAGGGAGAAATGGTAGAGGCCAAG : 539
TrPEPCa2 : CCTGGCTCTGTGATGGGAACCCTTCGGTCAACTGAGCAGGGAGAGATGGTGCAGGCCGAG : 447
TrPEPCa3 : CCTGGCTCTGTGATGGGAACCCTTCGGTCAACTGAGCAGGGAGAGATGGTGCAGGCCGAG : 446

*       560         *       580         *       600
TrPEPCa1 : TTTGGGTTACCACAGATAGCTGTTAGACAACTTGANN----------------------- : 576
TrPEPCa2 : TTTGGGTTGCCACAGACAGCAGTTAGACAACTTGAAATATACACAACAGCTGTGCTACTT : 507
TrPEPCa3 : TTTGGGTTGCCACAGACAGCAGTTAGACAACTTGAAATATACACAACAGCTGTGCTACTT : 506
```

FIGURE 18

```
                    *         620         *         640         *         660
TrPEPCa1 : ------------------------------------------------------------ :   -
TrPEPCa2 : GCTACACGTCGTCCACCACTCCCACCTCGAGAAGAAAAATGGCGTAATCTAATGGAAGAC : 567
TrPEPCa3 : GCTACACGTCGTCCACCACTCCCACCTCGAGAAGAAAAATGGCGTAATCTAATGGAAGAC : 566

*         680         *         700         *
TrPEPCa1 : ------------------------------------------------------------ :   -
TrPEPCa2 : ATN--------------------------------------------------------- : 570
TrPEPCa3 : ATTTCAAAAATCAGTTGTCAGTCCTACCGCAGTGTAGTCTATGAAAATCCAGN        : 619
```

FIGURE 18 (cont.)

```
                   *        20         *        40         *        60
TrPEPCb1 : GNAAGGGACAAGCTCTATCGTACTCGTGAGCGGTCTCGCTATCTCTTAGCTCATGGCTAT : 60
TrPEPCb2 : GAAAGGGACAAGCTCTATCGTACTCGTGAGCGGTCTCGCTATCTCTTAGCTCATGGCTAT : 60

*        80         *       100         *       120
TrPEPCb1 : TCTGAAATTCCTGAAGAAGCCACATTCACCGATGTTGATGAGTTCTTGGAACCTCTTGAA : 120
TrPEPCb2 : TCTGAAATTCCTGAAGAAGCCACATTCACCGATGTTGATGAGTTCTTGGAACCTCTTGAA : 120

*       140         *       160         *       180
TrPEPCb1 : CTATGCTACAGATCACTCTGTGCTTGTGGTGATCGTGCGATTGCCGATGGAAGCCTTCTT : 180
TrPEPCb2 : CTATGCTACAGATCACTCTGTGCTTGTGGTGATCGTGCGATTGCCGATGGAAGCCTTCTT : 180

*       200         *       220         *       240
TrPEPCb1 : GATTTCTTGAGGCAAGTTTCCACTTTTGGACTGTCACTGGTAAGACTTGATATAAGGCAA : 240
TrPEPCb2 : GATTTCTTGAGGCAAGTTTCCACTTTTGGACTGTCACTGGTAAGACTTGATATAAGGCAA : 240

*       260         *       280         *       300
TrPEPCb1 : GAGTCAGATCGTCACACGGACGTGATGGATGCCATTACCAAACATTTGGAAATTGGATCC : 300
TrPEPCb2 : GAGTCAGATCGTCACACGGACGTGATGGATGCCATTACCAAACATTTGGAAATTGGATCC : 300

*       320         *       340         *       360
TrPEPCb1 : TACCAAGACTGGTCTGAAGAAAAAAGACAGGAATGGCTTTTGTCTGAGTTGGTTGGCAAA : 360
TrPEPCb2 : TACCAAGACTGGTCTGAAGAAAAAAGACAGGAATGGCTTTTGTCTGAGTTGGTTGGCAAA : 360

*       380         *       400         *       420
TrPEPCb1 : AGGCCGCTTTTTGGACCTGACCTACCTCAAACCGATGAAATTAGAGAAGTTTTAGAGACA : 420
TrPEPCb2 : AGGCCGCTTTTTGGACCTGACCTACCTCAAACCGATGAAATTAGAGAAGTTTTAGAGACA : 420

*       440         *       460         *       480
TrPEPCb1 : TTTCATGTCATAGCAGAACTTCCATCAGACAACTTTGGAGCCTATATCATTTCGATGGCA : 480
TrPEPCb2 : TTTCATGTCATAGCAGAACTTCCATCAGACAACTTTGGAGCCTATATCATTTCGATGGCA : 480

*       500         *       520         *       540
TrPEPCb1 : ACTGCCCCGTCTGATGTGCTAGCGGTTGAACTTCTTCAACGTGAATGCAAAATCAAGAAT : 540
TrPEPCb2 : ACTGCCCCGTCTGATGTGCTAGCGGTTGAACTTCTTCAACGTGAATGCAAAATCAAGAAT : 540

*       560         *       580         *
TrPEPCb1 : CCGTTAAGAGTTGTTCCGTTGTTTGAGAAACTTGCTGATCTCGAGTCTGCTCCTGCTG : 598
TrPEPCb2 : CCGTTAAGAGTTGTTCCGTTGTTTGAGAAACTTGCTGATCTCGN-------------- : 584
```

FIGURE 19

```
                 *         20         *         40         *         60
TrPEPCc1 : GTCACATGACTNACTATATCTCCCTTTCTCTAACTCCGTGATCAAGGCGTTAGTTAGTTA :  60
TrPEPCc2 : ------TGACAAACNATATCTCCCTTTCTCTAACTCCGTGATCAAGGCGTTAGTTAGTTA :  54

*         80         *        100         *        120
TrPEPCc1 : CACAAATTGCTGTTAGGTTTCGTTGTACTTTCCCGTGCAATCCATAGTATCTTGGAGGAA : 120
TrPEPCc2 : CACAAATTGCTGTTAGGTTTCGTTGTACTTTCCCGTGCAATCCATAGTATCTTGGAGGAA : 114

*        140         *        160         *        180
TrPEPCc1 : CAAACTAGATTTTCCACCTAGGTCGTCACGAGATTTTCCTCTTCACTATTTTTCTTTTTC : 180
TrPEPCc2 : CAAACTAGATTTTCCACCTAGGTGGTCACGAGATTTTCCTCTTCACTATTTTTCTTTTTC : 174

*        200         *        220         *        240
TrPEPCc1 : ATATAATAACTCAACACTTTTTCTAGCTACTTACTAGTACTGTGTAACACAAATTTTATT : 240
TrPEPCc2 : ATATAATAATTCAACACTTTTTCTAGCTACTTACTAGTACTGTGTAACACAAATTTTATT : 234

*        260         *        280         *        300
TrPEPCc1 : CATTATGGCTACTCCTCGCAACATTGAAAAAATGGCTTCAATTGATGCTCAATTGAGACT : 300
TrPEPCc2 : CATTATGGCTACTCCTCGCAACATTGAAAAAATGGCTTCAATTGATGCTCAATTGAGACT : 294

*        320         *        340         *        360
TrPEPCc1 : ACTAGCACCAAGGAAAGTTTCTGATGATGATAAACTTGTCGAGTATGATGCTTTGTTATT : 360
TrPEPCc2 : ACTAGCACCAAGGAAAGTTTCTGATGATGATAAACTTGTCGAGTATGATGCTTTGTTATT : 354

*        380         *        400         *        420
TrPEPCc1 : GGATCGATTCCTTGACATTCTTCAAGATTTGCATGGAGAAGATATCAGACAAACTGTTCA : 420
TrPEPCc2 : GGATCGATTCCTTGACATTCTTCAAGATTTGCATGGAGAAGATATCAGACAAACTGTTCA : 414

*        440         *        460         *        480
TrPEPCc1 : AGATTGTTATGAGTTATCGGCAGAGTATGAAGGGGAGCTTAGGCCGGAGAAATTGGAGGA : 480
TrPEPCc2 : AGATTGTTATGAGTTATCGGCAGAGTATGAAGGGGAGCTTAAGCCGGAGAAATTGGAGGA : 474

*        500         *        520         *        540
TrPEPCc1 : ACTTGGGAATATGCTTACTGGTCTTGATGCTGGAGATTCTATTGTTATAGCAAAATCATT : 540
TrPEPCc2 : ACTTGGGAATATGCTTACTGGTCTTGATGCTGGAGATTCTATTGTTATAGCAAAATCATT : 534

*        560         *
TrPEPCc1 : TTCTCATATGCTTAATTTGGCAAACTTGGCAGAGN : 575
TrPEPCc2 : TTN-------------------------------- : 537
```

FIGURE 20

```
                     *         20         *         40         *         60
TrCSa1 : GNNNCNCNACCATTACGTTAATTACATTTTCTNCTTTCGCCTTGTTCTTTTCTCTTCTCAA :  60
TrCSa2 : --------------ACATTCGTNATNCTTTTCTCTTTCGCCTTGTTCTTTTCTCTTCT-AA :  45
TrCSa3 : ------------------------------------------------------------ :   -
TrCSa4 : ------------------------------------------------------------ :   -
TrCSa5 : ------------------------------------------------------------ :   -
TrCSa6 : ------------------------------------------------------------ :   -
TrCSa7 : ------------------------------------------------------------ :   -

*         80         *        100         *        120
TrCSa1 : TATAAAGACCAATTCAATTCCCAATTCTTTTGGATCCGAAATCATTCATTCTACGCTTCT : 120
TrCSa2 : TATAAAGACC-ATTCAATTCCCAATTCTTTTGGATCCGAAATCATTCATTCTACGCTTCT : 104
TrCSa3 : -------------TACCGNAAAC--TTNCTTNC-TACTTTTNCAACCNCTNCGNCT     :  40
TrCSa4 : --------------------------------------------GTNCCCGAAA      :  10
TrCSa5 : ------------------------------------------------------------ :   -
TrCSa6 : ------------------------------------------------------------ :   -
TrCSa7 : ------------------------------------------------------------ :   -

*        140         *        160         *        180
TrCSa1 : TCTCTCTTCTCTGCGTTTCAAACCCTAGTTGTTTTGTTGATTGATCTTAATGGCGTTCTT : 180
TrCSa2 : TCTCTCTTCTCTGCGTTTCAAACCCTAGTTGTTTTGTTGATTGATCTTAATGGCGTTCTT : 164
TrCSa3 : TCTTNCTTCTCTGCGTTTCAAACCCTAGTTGTTTTGTTGATTGATCTAAATGGCGTTCTT : 100
TrCSa4 : TNNTTCCTTTCTAC-TTT-TNACCCT-GTTGTTTNGTTGATTGATCTAAATGGCGTTCTT :  67
TrCSa5 : ------------------------------------------------------------ :   -
TrCSa6 : ------------------------------------------------------------ :   -
TrCSa7 : ------------------------------------------------------------ :   -

*        200         *        220         *        240
TrCSa1 : TCGAAGCGTTTCTGCGCTTTCAAAACTACGATCTCGTGTGGGTCAACAACCTAGTCTTGC : 240
TrCSa2 : TCGAAGCGTTTCTGCGCTTTCAAAACTACGATCTCGTGTGGGTCAACAACCTAGTCTTGC : 224
TrCSa3 : TCGAAGCGTTTCTGCGCTTTCAAAACTACGATCTCGTGTGGGTCAACAACCTAGTCTGGC : 160
TrCSa4 : TCGAAGCGTTTCTGCGCTTTCAAAACTACGATCTCGTGTGGGTCAACAACCTAGTCTTGC : 127
TrCSa5 : ------------------------------------------------------------ :   -
TrCSa6 : ------------------------------------------------------------ :   -
TrCSa7 : ------------------------------------------------------------ :   -

*        260         *        280         *        300
TrCSa1 : TAATTCAGTTAGATGGCTCCAAACTCCAAGCTCCAGTAACACTGATCTTTATTCTGAGAT : 300
TrCSa2 : TAATTCAGTTAGATGGCTCCAAACTCCAAGCTCCAGTAACACTGATCTTTATTCTGAGAT : 284
TrCSa3 : TAATTCAGTTAGATGGCTCCAAACTCCAAGCTCCAGTAACACTGATCTTTATTCTGAGAT : 220
TrCSa4 : TAATTCAGTTAGATGGCTCCAAACTCCAAGCTCCAGTAACACTGATCTTTATTCTGAGAT : 187
TrCSa5 : ------------------------------------------------------------ :   -
TrCSa6 : ------------------------------------------------------------ :   -
TrCSa7 : ------------------------------------------------------------ :   -

*        320         *        340         *        360
TrCSa1 : GAAGGAGCTAGTTCCAGAGTATCAGGAACGTGTTAAGAAGTTGAAGAAAGACCATGGAAG : 360
TrCSa2 : GAAGGAGCTAGTTCCAGAGTATCAGGAACGTGTTAAGAAGTTGAAGAAAGACCATGGAAG : 344
TrCSa3 : GAAGGAGCTAGTTCCAGAGTATCAGGAACGTGTTAAGAAGTTGAAGAAAGACCATGGAAG : 280
TrCSa4 : GAAGGAGCTAGTTCCAGAGTATCAGGAACGTGTTAAGAAGTTGAAGAAAGACCATGGAAG : 247
TrCSa5 : ------------------------------------------------------------ :   -
TrCSa6 : ------------------------------------------------------------ :   -
TrCSa7 : ------------------------------------------------------------ :   -
```

FIGURE 21

```
                      *         380         *         400         *         420
TrCSa1 : TGTTGAATTGGGAAAAATCACAGCTGATATGGTACTTGGTGGAATGAGAGGAATGACTGC : 420
TrCSa2 : TGTTGAATTGGGAAAAATCACAGCTGATATGGTACTTGGTGGAATGAGAGGAATGACTGC : 404
TrCSa3 : TGTTGAATTGGGAAAAGTCACAGCTGATATGGTACTTGGTGGAATGAGAGGAATGACAGC : 340
TrCSa4 : TGTTGAATTGGGAAAAATCACAGCTGATATGGTACTTGGTGGAATGAGAGGAATGACTGC : 307
TrCSa5 : --------GNGGAAAAATACAGCTGATATGGTACTTGGTGGAATGAGAGGAATGACTGC :  51
TrCSa6 : ------------------------------------GNAGAGGAATGACTGC :  16
TrCSa7 : ------------------------------------------------------------ :   -

*         440         *         460         *         480
TrCSa1 : TTTAGTGTGGCTAGGCTCAGCTGTTGACCCAGATGAGGGAATTCGCTTTAGGGGCATGAC : 480
TrCSa2 : TTTAGTGTGGCTAGGCTCAGCTGTTGACCCAGATGAGGGAATTCGCTTTAGGGGCATGAC : 464
TrCSa3 : TTTAGTGTGGCTAGGCTCAGCTGTTGACCCAGATGAGGGAATTCGCTTTAGGGGCATGAC : 400
TrCSa4 : TTTAGTGTGGCTAGGCTCAGCTGTTGACCCANATGAGGGAATTCGCTTTAGGGGCATGAC : 367
TrCSa5 : TTTAGTGTGGCTAGGCTCAGCTGTTGACCCAGATGAGGGAATTCGCTTTAGGGGCATGAC : 111
TrCSa6 : TTTAGTGTGGCT-GGCT-NGCTGTTGACCCAGATGAGGGAATTCGCTTTAGGGGCATGAC :  74
TrCSa7 : ------------------------------------------------------------ :   -

*         500         *         520         *         540
TrCSa1 : AATTCCTGACTGCCAGAAAACACTTCCAGGTGCTTTTCCTGGTGGGGAGCCTTTGCCCGA : 540
TrCSa2 : AATTCCTGACTGCCAGAAAACACTTCCAGGTGCTTTTCCTGGTGGGGAGCCTTTGCCCGA : 524
TrCSa3 : AATTCCTGACTGCCAGAAAACACTTCCAGGTGCTTTTCCTGGTGGGGAGCCTTTGCCCGA : 460
TrCSa4 : AATTCCTGACTGCCAGAAAACACTTGCAGGTGCTTTTNCTGGCGGGGAGNCTTTGNCCNA : 427
TrCSa5 : AATTCCTGACTGCCAGAAAACACTTCCAGGTGCTNTTCCTGGTGGGGAGCCTTTGCCCGA : 171
TrCSa6 : AATTCCTGACTGCCAG-AAACACTTCCAGGTGCTTTTCCTGGTGGGGAGCCTTTGCCCGA : 133
TrCSa7 : ------------------------------------------------------------ :   -

*         560         *         580         *         600
TrCSa1 : GGCTATACTGTGGCTTCTATTGACCGGAAAGGTACCAAGTAAAGAGCAAGTAGATTCATT : 600
TrCSa2 : GGCTATACTGTGGCTTCTATTGACCGGAAAGGTACCAAGTAAAGAGCAAGTAGATTCATT : 584
TrCSa3 : GGCTATACTGTGGCTNCNATTGACCGGAAAGGTACCAAGTAAAGAGCAAGTAGATTCATT : 520
TrCSa4 : GGCTATACTGNGGNTTNTATTGACCGGNN------------------------------ : 456
TrCSa5 : GGCTATACTGTGGCTTCTATTGACCGGAAAGGTACCAAGTAAAGAGCAAGTAGATTCATT : 231
TrCSa6 : GGCTATACTGTGGCTTCTATTGACCGGAAAGGTACCAAGTAAAGAGCAAGTAGATTCATT : 193
TrCSa7 : ------------------------------------------------------------ :   -

*         620         *         640         *         660
TrCSa1 : AGCTCACGAATTGCGAAGTCGTGCAAAAATCCCAGAGTATGCTTACAAGGCAATTGATGC : 660
TrCSa2 : AGCN-------------------------------------------------------- : 588
TrCSa3 : AGCTCACGAATTGCGAAGTCGTGCAAAAATCCCAGAGTATGCTTACAAGGCAATTGATGC : 580
TrCSa4 : ------------------------------------------------------------ :   -
TrCSa5 : AGCTCACGAATTGCGAAGTCGTGCAAAAATCCCAGAGTATGCTTACAAGGCAATTGATGC : 291
TrCSa6 : AGCTCACGAATTGCGAAGTCGTGCAAAAATCCCAGAGTATGCTTACAAGGCAATTGATGC : 253
TrCSa7 : ------------------------------------------------------------ :   -

*         680         *         700         *         720
TrCSa1 : ACTGCCTGTTTCTGCTCATCCAATGACACAAN---------------------------- : 692
TrCSa2 : ------------------------------------------------------------ :   -
TrCSa3 : ACTGCCTGTTTCTGCTCATCCAATGACACAATTTAGTACTGGTGTAATGGCCCTCCAGGT : 640
TrCSa4 : ------------------------------------------------------------ :   -
TrCSa5 : ACTGCCTGTTTCTGCTCATCCAATGACACAATTTAGTACTGGTGTAATGGCCCTCCAGGT : 351
TrCSa6 : ACTGCCTGTTTCTGCTCATCCAATGACACAATTTAGTACTGGTGTAATGGCCCTCCAGGT : 313
TrCSa7 : ------------------------------------------------------------ :   -
```

FIGURE 21 (cont.)

```
                    *         740         *         760         *         780
TrCSa1 : ------------------------------------------------------------       :   -
TrCSa2 : ------------------------------------------------------------       :   -
TrCSa3 : GGAGAGTGAGTTTACAAAGGCATA GAGAGTGGGATACAT ------------------         : 681
TrCSa4 : ------------------------------------------------------------       :   -
TrCSa5 : GGAGAGTGAGTTTACAAAGGCATACGAGAGTGGGATACATAAGTCAAGGTATTGGGAGCC        : 411
TrCSa6 : GGAGAGTGAGTTTACAAAGGCATACGAGAGTGGGATACATAAGTCAAGGTATTGGGAGCC        : 373
TrCSa7 : --------------------- CNTC AGAGTGGGA NCNT AGT AAGG ATTGGGAGCC       :  34

*         800         *         820         *         840
TrCSa1 : ------------------------------------------------------------       :   -
TrCSa2 : ------------------------------------------------------------       :   -
TrCSa3 : ------------------------------------------------------------       :   -
TrCSa4 : ------------------------------------------------------------       :   -
TrCSa5 : AACTTATGAGGATAGCTTGAATTTAATTGCTCGTTTGCCTGGAATTGCTGCCTATATTTA        : 471
TrCSa6 : AACTTATGAGGATAGCTTGAATTTAATTGCTCGTTTGCCTGGAATTGCTGCCTATATTTA        : 433
TrCSa7 : -ACTTATGAGGAT-GCTTGAATTTAATTGCTCGTTTGCCTGGAATTGCTGCCTATATTTA        :  92

*         860         *         880         *         900
TrCSa1 : ------------------------------------------------------------       :   -
TrCSa2 : ------------------------------------------------------------       :   -
TrCSa3 : ------------------------------------------------------------       :   -
TrCSa4 : ------------------------------------------------------------       :   -
TrCSa5 : TCGACGGATATACAAGGATGGAAAAATCATACCATTGGATGATTCTTTGGATTATGGTGC        : 531
TrCSa6 : TCGACGGATATACAAGGATGGAAAAATCATACCATTGGATGATTCTTTGGATTATGGTGC        : 493
TrCSa7 : TCGACGGATATACAAGGATGGAAAAATCATACCATTGGATGATTCTTTGGATTATGGTGC        : 152

*         920         *         940         *         960
TrCSa1 : ------------------------------------------------------------       :   -
TrCSa2 : ------------------------------------------------------------       :   -
TrCSa3 : ------------------------------------------------------------       :   -
TrCSa4 : ------------------------------------------------------------       :   -
TrCSa5 : AAACTATGCTCACATGTTAGGATTTGATGATCCAGAAACGCTGGAGTTTATGAGGCTGTA        : 591
TrCSa6 : AAACTATGCTCACATGTTAGGATTTGATGATCCAGAAACGCTGGAGTTTATGAGGCTGTA        : 553
TrCSa7 : AAACTATGCTCACATGTTAGGATTTGATGATCCAGAAACGCTGGAGTTTATGAGGCTGTA        : 212

*         980         *        1000         *        1020
TrCSa1 : ------------------------------------------------------------       :   -
TrCSa2 : ------------------------------------------------------------       :   -
TrCSa3 : ------------------------------------------------------------       :   -
TrCSa4 : ------------------------------------------------------------       :   -
TrCSa5 : TATTTCTAT N --------------------------------------------           : 601
TrCSa6 : TATTTCTATCCATAGTGATCATGAAGG N ------------------------------       : 581
TrCSa7 : TATTTCTATCCATAGTGATCATGAAGG GGCAACGTTAGTTCTCACACAGCTCACCTAGT        : 272

*        1040         *        1060         *        1080
TrCSa1 : ------------------------------------------------------------       :   -
TrCSa2 : ------------------------------------------------------------       :   -
TrCSa3 : ------------------------------------------------------------       :   -
TrCSa4 : ------------------------------------------------------------       :   -
TrCSa5 : ------------------------------------------------------------       :   -
TrCSa6 : ------------------------------------------------------------       :   -
TrCSa7 : TGCTAGTTCACTATCAGATCCTTATCTTGCATTCGCAGCTGCTCTGAATGGTTTAGCTGG        : 332
```

FIGURE 21 (cont.)

```
                    *         1100         *         1120         *         1140
TrCSa1  : ------------------------------------------------------------  :   -
TrCSa2  : ------------------------------------------------------------  :   -
TrCSa3  : ------------------------------------------------------------  :   -
TrCSa4  : ------------------------------------------------------------  :   -
TrCSa5  : ------------------------------------------------------------  :   -
TrCSa6  : ------------------------------------------------------------  :   -
TrCSa7  : CCCACTGCATGGTTTAGCCAATCAGGAAGTTCTACGATGGATCAGAAACATAGTTAAGGA  : 392

*         1160         *         1180         *         1200
TrCSa1  : ------------------------------------------------------------  :   -
TrCSa2  : ------------------------------------------------------------  :   -
TrCSa3  : ------------------------------------------------------------  :   -
TrCSa4  : ------------------------------------------------------------  :   -
TrCSa5  : ------------------------------------------------------------  :   -
TrCSa6  : ------------------------------------------------------------  :   -
TrCSa7  : GTTTGGAACTCCAAACATAAGTACAGAACAATTGAGCGACTACATTCATAAAACATTGAA  : 452

*         1220         *         1240         *         1260
TrCSa1  : ------------------------------------------------------------  :   -
TrCSa2  : ------------------------------------------------------------  :   -
TrCSa3  : ------------------------------------------------------------  :   -
TrCSa4  : ------------------------------------------------------------  :   -
TrCSa5  : ------------------------------------------------------------  :   -
TrCSa6  : ------------------------------------------------------------  :   -
TrCSa7  : CAGTGGCCAGGTTGTGCCTGGATATGGACATGGAGTTTTGCGCAATACAGACCCAAGATA  : 512

*         1280         *         1300
TrCSa1  : -------------------------------------------------  :   -
TrCSa2  : -------------------------------------------------  :   -
TrCSa3  : -------------------------------------------------  :   -
TrCSa4  : -------------------------------------------------  :   -
TrCSa5  : -------------------------------------------------  :   -
TrCSa6  : -------------------------------------------------  :   -
TrCSa7  : CACTTGCCAGAGGGAGTTTGCATTGAAGCATTTGCCTAATGATCCAN     : 559
```

FIGURE 21 (cont.)

```
                        *         20         *         40         *         60
TrCSb1 : CNTTTCNTTTCCACAGCATCCTAATCCTAATCCTAATCCTAATCCTATTACTAATTACTA :  60
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : ------------------------------------------------------------ :   -
TrCSb7 : ------------------------------------------------------------ :   -

*         80         *        100         *        120
TrCSb1 : ATTACTAATTACTAGTACTAATTAGTAATACCGATCCCTTTTTCTCGAACCCATTCATTC : 120
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : ------------------------------------------------------------ :   -
TrCSb7 : ------------------------------------------------------------ :   -

*        140         *        160         *        180
TrCSb1 : AA  C AAGAAGGAAAAACAAAAT-CACACAAACAAACATCTTACAACAATGTCAACGAC : 179
TrCSb2 : --GNAG AGAAGGAAA C  C-AAATCCACA A  - AAAC-TCTTACAACAATGTCAAC AC :  55
TrCSb3 : --GN G AGAAGGAAA  ACAAAAT CACA A A AAAACATCTTACAACAATGTCAAC AC :  58
TrCSb4 : ---- C AA  AGGAAAAAC-AAAT-- CACAAAC- AACATCTTAC-ACAATGTC-ACGAC :  50
TrCSb5 : ------- G AAGGAAAAAC-AAAT-- C-CAAAC-AAC-TCTTAC-ACAATGTC-ACGAC :  45
TrCSb6 : ------------------------------------------------------------ :   -
TrCSb7 : ------------------------------------------------------------ :   -

*        200         *        220         *        240
TrCSb1 : AACTACTACAACCGACGAATCCAAGCTGCACGACGCTGCACGGAACCGTTTGGC ACCCT : 239
TrCSb2 : AACTACTACAACCGACGAATCCAAGCTGCACGACGCTGCACGGAACCGTTTGGCCACCCT : 115
TrCSb3 : AACTACTACAACCGACGAATCCAAGCTGCACGACGCTGCACGGAACCGTTTGGCCACCCT : 118
TrCSb4 : AACTACTACAACCGACGAATCCAAGCTGCACGACGCTGCACGGAACCGTTT GCCACCCT : 110
TrCSb5 : AACTACTACAACCGACGAATCCAAGCTGCACGACGCTGCACGGAACCGTTTGGC ACCCT : 105
TrCSb6 : ------------------------------------------------------------ :   -
TrCSb7 : ------------------------------------------------------------ :   -

*        260         *        280         *        300
TrCSb1 : CTCAGCTCACTTGCTTCCTTCCTCCACAA CTCCGC GCGCT CTCCATCCTAT CACCT : 299
TrCSb2 : CTCAGCTCACTTGCTTCCTTCCTCCACAACCTCCGCCGCGCTCCTCCATCCTATTCACCT : 175
TrCSb3 : CTCAGCTCACTTGCTTCCTTCCTCCACAACCTCCGCCGCGCTCCTCCATCCTATTCACCT : 178
TrCSb4 : CTCAGCTCACTTGCTTCCTTCCTCCACAACCTCCGCCGCGCTCCTCCATCCTATTCACCT : 170
TrCSb5 : CTCAGCTCACTTGCTTCCTTCCTCCACAA CTCCGC GCGCT CTCCATCCTAT CACCT : 165
TrCSb6 : ------------------------------------------------------------ :   -
TrCSb7 : ------------------------------------------------------------ :   -

*        320         *        340         *        360
TrCSb1 : TTCTTCTTCCTC GGGATCTCCCCACCGTCTAATGTCAAAGGAACACTCACCGTTGTTGA : 359
TrCSb2 : TTC  CTTCCTCCGGGATCTCCCCACCGTCTAATGTCAAAGGAACACTCACCGTTGTTGA : 235
TrCSb3 : TTC  CTTCCTCCGGGATCTCCCCACCGTCTAATGTCAAAGGAACACTCACCGTTGTTGA : 238
TrCSb4 : TTCTTCTTCCTCCGGGATCTCCCCACCGTCTAATGTCAAAGGAACACTCACCGTTGTTGA : 230
TrCSb5 : TTCTTCTTCCTC GGGATCTCCCCACCGTCTAATGTCAAAGGAACACTCACCGTTGTTGA : 225
TrCSb6 : ------------------------------------------------------------ :   -
TrCSb7 : ------------------------------------------------------------ :   -
```

FIGURE 22

```
                 *         380         *         400         *         420
TrCSb1 : TGAACGTACCGGGAAGAAGTATACCATTGAGGTCTCTCCTGATGGCACCGTTAAAGCCAA : 419
TrCSb2 : TGAACGTACCGGGAAGAAGTATAACATTGAGGTCTCACCTGATGGCACCGTTAAAGCCAA : 295
TrCSb3 : TGAACGTACCGGGAAGAAGTATAACATTGAGGTCTCACCTGATGGCACCGTTAAAGCCAA : 298
TrCSb4 : TGAACGTACCGGGAAGAAGTATACCATTGAGGTCTCTCCTGATGGCACCGTTAAAGCCAA : 290
TrCSb5 : TGAACGTACCGGGAAGAAGTATACCATTGAGGTCTCTCCTGATGGCACCGTTAAAGCCAA : 285
TrCSb6 : ------------------------------------------------------------ :   -
TrCSb7 : ------------------------------------------------------------ :   -

*         440         *         460         *         480
TrCSb1 : TGATTTCAAGAAGATATCAACTGGGAAGAATGATAAGGGGCTCAAACTTTATGATCCTGG : 479
TrCSb2 : TGATTTCAAGAAGATATCAACTGGGAAGAATGATAAGGGACTCAAACTTTATGATCCTGG : 355
TrCSb3 : TGATTTCAAGAAGATATCAACTGGGAAGAATGATAAGGGACTCAAACTTTATGATCCTGG : 358
TrCSb4 : TGATTTCAAGAAGATATCCACTGGGAAGAATGATAAGGGACTCAAACTTTATGATCCTGG : 350
TrCSb5 : TGATTTCAAGAAGATATCAACTGGGAAGAATGATAAGGGGCTCAAACTTTATGATCCTGG : 345
TrCSb6 : ------------------------------------------------------------ :   -
TrCSb7 : ---------------------------------------A------------------- :   1

*         500         *         520         *         540
TrCSb1 : ATATTTAAACACTGCTCCTGTGCGATCAACAATTTCTTATATTGATGGTGATGAGGGAAT : 539
TrCSb2 : ATATTTAAACACTGCTCCTGTGCGATCAACAATTTCTTATATTGATGGTGATGAGGGAAT : 415
TrCSb3 : ATATTTAAACACTGCTCCTGTGCGATCAACAATTTCTTATATTGATGGTGATGAGGGAAT : 418
TrCSb4 : ATATTTAAACACTGCTCCTGTGCGATCAACAATTTCTTATATTGATGGTGATGAGGGAAT : 410
TrCSb5 : ATATTTAAACACTGCTCCTGTGCGATCAACAATTTCTTATATTGATGGTGATGAGGGAAT : 405
TrCSb6 : ------------------------------------------------------------ :   -
TrCSb7 : ------------------------------------------------------------ :   -

*         560         *         580         *         600
TrCSb1 : CCTTAGATATAGAGGATACCCCATTGAAGAGTTGGCCGAGAAAAGCACCTTTCCGGAAGT : 599
TrCSb2 : CCTTAGATATAGAGGATACCCCATTGAGGAGTTGGCCGAGAAAAGCACCTTTCCGGAAGT : 475
TrCSb3 : CCTTAGATATAGAGGATACCCCATTGAGGAGTTGGCCGAGAAAAGCACCTTTCCGGAAGT : 478
TrCSb4 : CCTTAGATATAGAGGATACCCCATTGAGGAGTTGGCCGAGAAAAGCACCTTTCCGGAAGT : 470
TrCSb5 : CCTTAGATATAGAGGATACCCCATTGAAGAGTTGGCCGAGAAAAGCACCTTTCCGGAAGT : 465
TrCSb6 : --------ATAGAGCT--CCNATTGAGGAGTTGG-CGAGAAAAGCACTTTTATGGAAGT :  49
TrCSb7 : ------------------------------------------------------------ :   -

*         620         *         640         *         660
TrCSb1 : GGCATATCTN-------------------------------------------------- : 609
TrCSb2 : GGCATATCTCATATTGTATGGAAATTTGCCTTCTGCAAATCAGTTACAAGAATGGGAATT : 535
TrCSb3 : GGCATATCTCATATTGTATGGAAATTTGCCTTCTGCAAATCAGTTACAAGAATGGGAATT : 538
TrCSb4 : GGCATATCTCATATTGTATGGAAATTTGCCTTCTGCAAATCAGTTACAAGAATGGGAATT : 530
TrCSb5 : GGCATATCTCATATTGTATGGAAATTTGCCTTCTGCAAATCAGTTACAAGAATGGGAATT : 525
TrCSb6 : GNCTTATCT-ATAATGTATGGAACTTTNCCTACTGAAACTAAGTTAGCTGAATGGAATTT : 108
TrCSb7 : ---------------------------------------GAATGGGAATT :  12

*         680         *         700         *         720
TrCSb1 : ------------------------------------------------------------ :   -
TrCSb2 : TGCTATATCTCAGCATTCAGCCTTACCTCAAGGAGTTTTGGATCTCATACAATN------ : 589
TrCSb3 : TGCTATATCTCAGCATTCAGCCTTACCTCAAGGAGTTTTGGATCTCATACAATCNN---- : 594
TrCSb4 : TGCTATATCTCAGCATTCAGCCTTACCTCAAGGAGTTTT--------------------- : 570
TrCSb5 : TGCTATATCTCAGCATTCAGCCTTACCTCAAGGAGTTTTGGATCTCATACAATCAATGCC : 585
TrCSb6 : NGCTATATCTCAGCATTCAGCNGTNCCAGAAGGAGTTTTGGATATCATACAATCAATGCC : 168
TrCSb7 : TGCTATATCT-AGCATT-AGCCTTACCTCAAGGAGTTTTGGATCTCATACAATCAATGCC :  70
```

FIGURE 22 (cont.)

```
              *         740         *         760         *         780
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : TCAAGNN----------------------------------------------------- : 592
TrCSb6 : TCAGGATGCACATCCTATGGGTGTCCTAGTGAATGCAATAAGCGCTCTTTCTGTTTTTCA : 228
TrCSb7 : TCAAGATGCACATCCTATGGGCGTGCTTGTTAATGCTCTAAGTGCTTTGTCTGTTTTTCA : 130

*         800         *         820         *         840
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : TCCTGACGCAATCCTGCTCTTAGAGGTCTTGATATTTACCACTCAAAGCAAGTGAGAGA : 288
TrCSb7 : TCCTGATGCAAATCCTGCTCTCAGAGGTCTTGACATCTACAACTCAAAGCAAGTGAGAGA : 190

*         860         *         880         *         900
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : CAAACAAATAGCACGGATTATTGGAAAGATTATAACAATTGCTGCTGCACTTTATCTTAG : 348
TrCSb7 : CAAACAAATAGTGCGGATTATTGGAAAGATAACAACAATTGCTGCTGCGATTAATCTTAG : 250

*         920         *         940         *         960
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : AATGGCAGGAAGGCCACCTGTGCTTCCATCCAACCAACTATCTTACACTGAGAACTTCCT : 408
TrCSb7 : ATTGGGAGGAAGGCCACCTGTTCTTCCATCCAACAAACTTTCTTACACAGAGAACTTCCT : 310

*         980         *        1000         *        1020
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : ATACATGCTTGATTCTTTAGGCAATCGGTCATATAAACCCAACCCTCAGCTAACTCGTGC : 468
TrCSb7 : TTACATGCTTGATTCTCTCTGGCAATCGGTCATATAAACCTAACCCTCGTCTAACTCGTGC : 370

*        1040         *        1060         *        1080
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : ACTAGACATTATCTTCATCCTGCATGCAGAACATGAAATGAATTGCTCTACATCTGCTGT : 528
TrCSb7 : ACTGGACATCATCTTCATCCTTCATGCAGAACATGAAATGAATTGCTCTACATCTGCTGT : 430
```

FIGURE 22 (cont.)

```
              *        1100         *        1120         *        1140
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : CCGACACCTTGCATCAAGCGGCGTCGATGTATAAACTGCTATTGCTGGGGN---------- : 579
TrCSb7 : ACGCCACCTTGCATCAAGTGGTGTCGATGTATACACTGCTATTGCTGGAGGTGTTGGAGC   : 490

*        1160         *        1180         *        1200
TrCSb1 : ------------------------------------------------------------ :   -
TrCSb2 : ------------------------------------------------------------ :   -
TrCSb3 : ------------------------------------------------------------ :   -
TrCSb4 : ------------------------------------------------------------ :   -
TrCSb5 : ------------------------------------------------------------ :   -
TrCSb6 : ------------------------------------------------------------ :   -
TrCSb7 : TCTGTATGGACCTCTTCATGGTGGAGCTAATGAGGCGGTCCTTAAAATGCTGAGTGAAAT   : 550

*        1220         *        1240
TrCSb1 : -------------------------------------------- :   -
TrCSb2 : -------------------------------------------- :   -
TrCSb3 : -------------------------------------------- :   -
TrCSb4 : -------------------------------------------- :   -
TrCSb5 : -------------------------------------------- :   -
TrCSb6 : -------------------------------------------- :   -
TrCSb7 : TGGAAGTGTCGATAACATTCCAGAGTTCATTGAAGGTGTTAANN   : 594
```

FIGURE 22 (cont.)

TrMDH pPZP221:TrMDH sense pPZP221:TrPEPC sense pPZP221:TrCSb sense pPZP221:TrCSd sense A
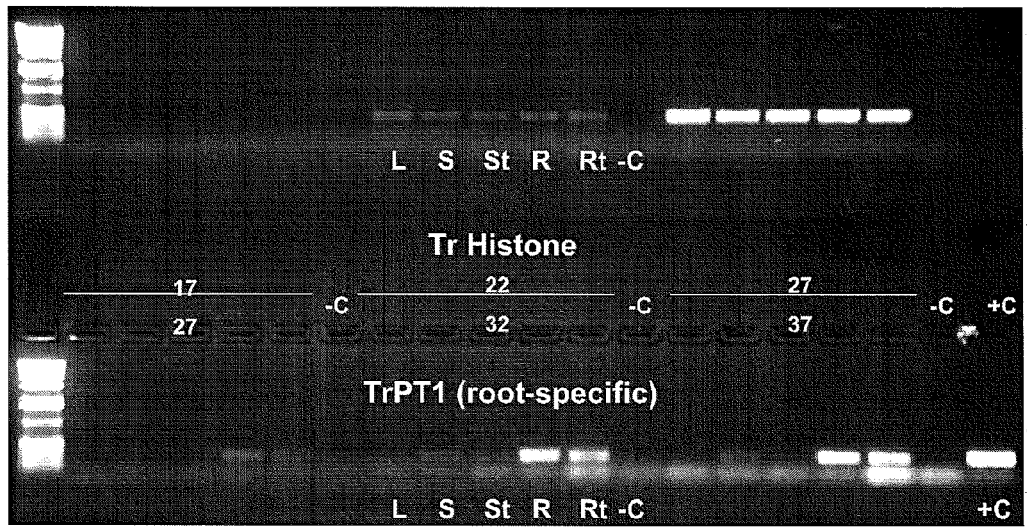
B
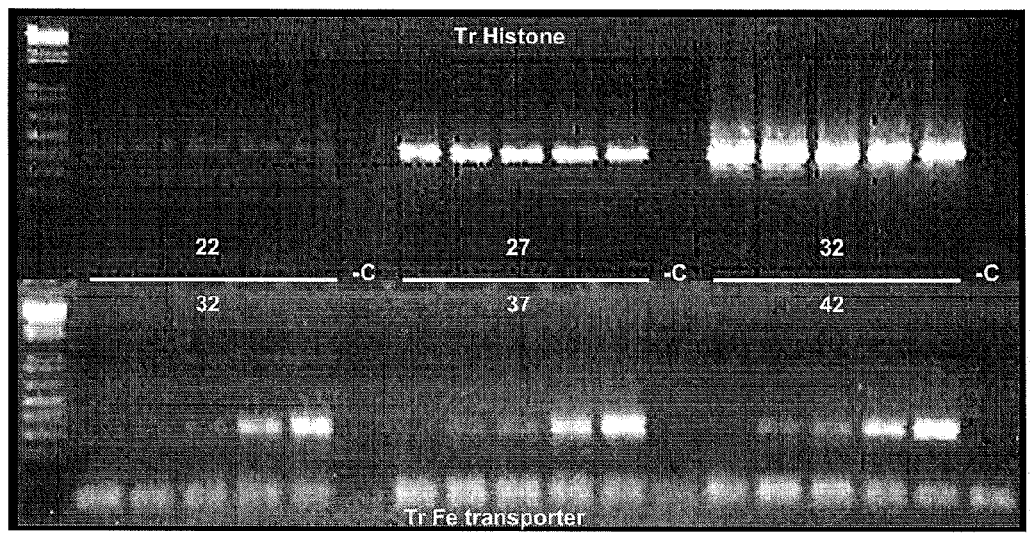
FIGURE 35

A
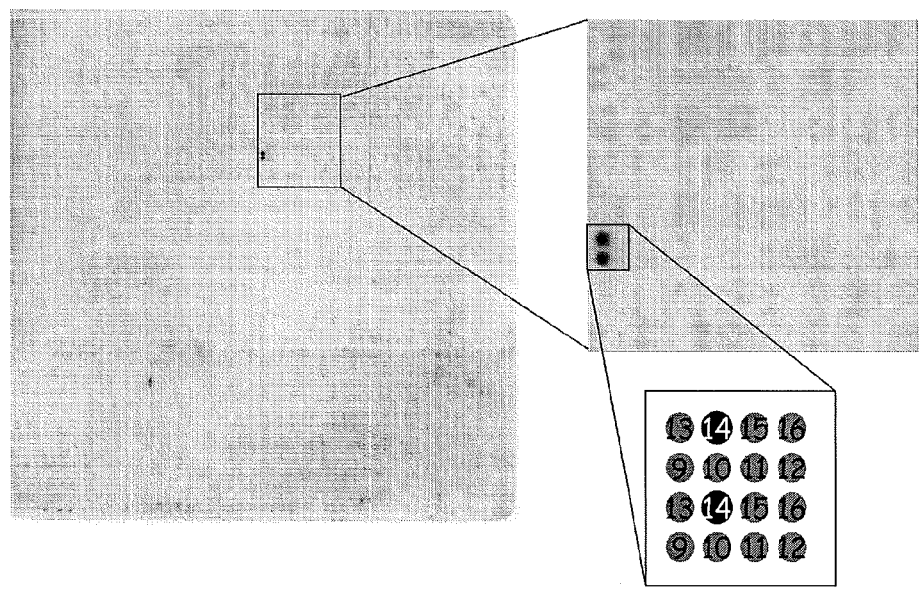
B
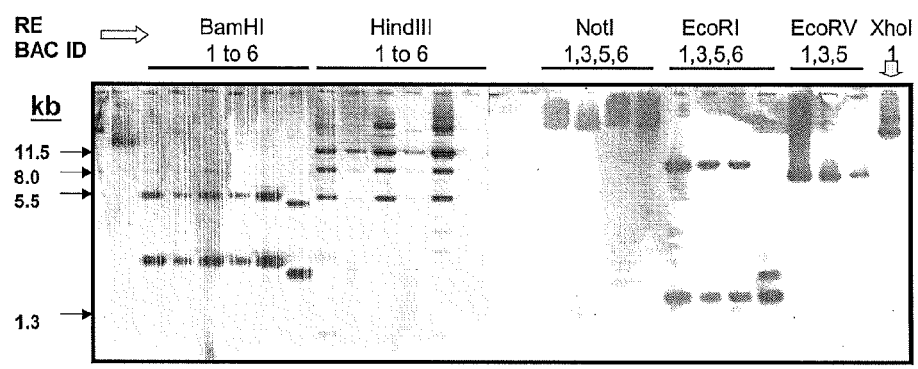
C
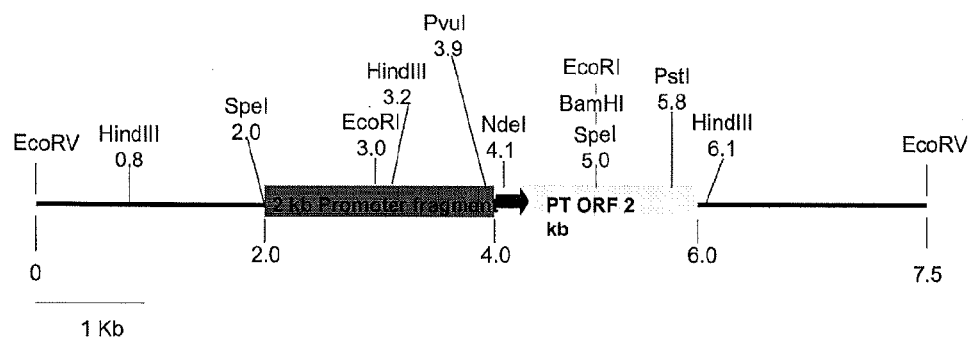
FIGURE 36

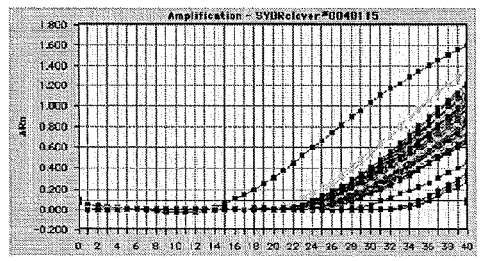 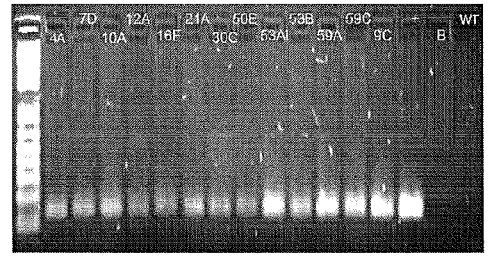
QPCR plots QPCR Result
FIGURE 38

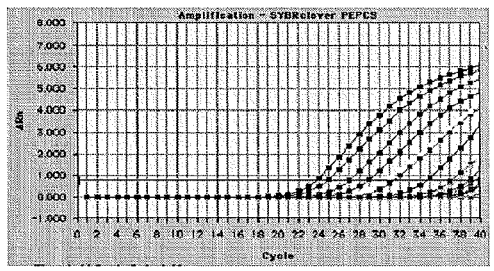 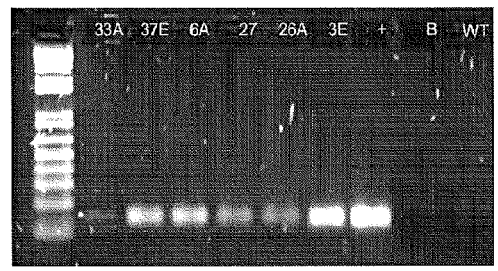
QPCR plots          QPCR Result
FIGURE 39

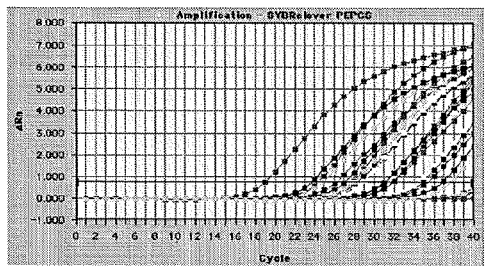 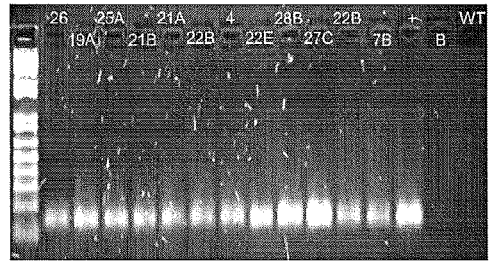
QPCR plots                QPCR Result
FIGURE 40

MANIPULATION OF ORGANIC ACID BIOSYNTHESIS AND SECRETION

This application is a §371 US national phase of PCT Application PCT/AU04/000493, filed Apr. 14, 2004, which was published in English on Oct. 21, 2004 as WO/2004/089066.

The present invention relates to nucleic acid fragments encoding amino acid sequences for organic acid biosynthetic enzyme polypeptides in plants, and the use thereof for the modification of organic acid biosynthesis and secretion in plants. In particularly preferred embodiments, the invention relates to the combinatorial expression of malate dehydrogenase (MDH) and/or phosphoenolpyruvate carboxylase (PEPC) and/or citrate synthase (CS) in plants to modify organic acid biosynthesis and secretion.

Documents cited in this specification are for reference purposes only and their inclusion is not acknowledgment that they form part of the common general knowledge in the relevant art.

Organic acids, such as citrate and malate, are key metabolites in plants. They are involved in numerous processes, including C4 and Crassulacean acid metabolism (CAM) photosynthesis, stomatal and pulvinual movement, nutrient uptake, respiration, nitrogen assimilation, fatty acid oxidation, and providing energy to bacteroids in root nodules. For example, malate plays a key role in root nodule metabolism and nitrogen fixation, serving as the primary carbon source for bacteroid maintenance and nitrogenase activity, and is also tightly linked to nodule nitrogen assimilation. Furthermore, the complexing role of organic acids produced and excreted from plant roots has also been associated with tolerance to the aluminium cation $Al^{3+}$ which is toxic to many plants at micromolar concentrations. Aluminium toxicity has been recognized as a major limiting factor of plant productivity on acidic soils, which account for approximately 40% of the earth's arable land.

The tricarboxylic acid cycle (TCA), also known as Krebs cycle (after its discoverer Hans Krebs) or citric acid cycle, moves electrons from organic acids to the oxidized redox cofactors $NAD^+$ and FAD, forming NADH, $FADH_2$, and carbon dioxide ($CO_2$). The reaction sequence of the TCA cycle involves: in a reaction catalysed by citrate synthase (CS), acetyl-CoA formed by the pyruvate dehydrogenase complex combines with oxaloacetate to produce the $C_6$ tricarboxylic acid, citrate. In the overall cycle, the citrate is oxidized to produce two molecules of $CO_2$ in a series of reactions that leads to the formation of one oxaloacetate, three NADH, one $FADH_2$, and one ATP. The resulting oxaloacetate reacts with another molecule of acetyl-CoA to continue the cycle. The oxidative decarboxylation of pyruvate yields an additional $CO_2$ and NADH. Thus the TCA cycle brings about the complete oxidation of pyruvate to three $CO_2$ plus 10 electrons, which are stored temporarily as 4 NADH and 1 $FADH_2$.

Cytosolic reactions generate products that are transported into the mitochondria to feed the TCA cycle. The nature of the end product of the glycolytic reactions in the cytosol of plants is determined by the relative activities of the three enzymes that can utilize phosphoenol-pyruvate (PEP) as substrate. Both pyruvate kinase and PEP-phosphatase form pyruvate; while PEP-carboxylase (PEPC) generates oxaloacetate. Pyruvate is transported directly into the mitochondrion. Oxaloacetate is either transported directly into the mitochondrion or first reduced to malate by cytosolic malate dehydrogenase (MDH).

Before entering the TCA cycle proper, pyruvate is oxidised and decarboxylated by the pyruvate dehydrogenase enzyme complex to form $CO_2$, acetyl-CoA, and NADH. The pyruvate dehydrogenase enzyme complex, which requires the bound cofactors thiamine pyrophosphate, lipoic acid, and FAD as well as free coenzyme A (CoASH) and $NAD^+$, links the TCA cycle to glycolysis.

It is known that the TCA cycle includes the following enzymes: pyruvate dehydrogenase, citrate synthase, citrate hydrolase, isocitrate dehydrogenase, oxoglutarate dehydrogenase, succinyl-CoA synthetase, succinate dehydrogenase, fumarase, malate dehydrogenase, NAD-malic enzyme and phosphoenolpyruvate carboxylase.

In particular, citrate synthase (CS) catalyses the condensation of acetyl-CoA and oxaloacetate to form the C6 molecule citrate and free CoASH, as the TCA cycle proper begins.

Malate dehydrogenase (MDH) catalyses the final step of the TCA cycle, oxidizing malate to oxaloacetate and producing NADH. This reaction catalysed by MDH is reversible, thus allowing also for the reversible reduction of oxaloacetate to malate. The enzyme MDH is important in several metabolic pathways, and higher plants contain multiple forms that differ in co-enzyme specificity and subcellular localization. Chloroplasts contain an $NADP^+$-dependent MDH that plays a critical role in balancing reducing equivalents between the cytosol and stroma. Plants also contain NAD-dependent MDHs which are found in a) mitochondria as part of the TCA cycle; b) cytosol and peroxisomes involved in malate-aspartate shuttles; and c) glyoxisomes functioning in β-oxidation. In root nodules of nitrogen-fixing legumes, such as white clover (*Trifolium repens*) and alfalfa (*Medicago sativa*), malate serves as the primary carbon source to support the respiratory needs of the bacterial microsymbiont and the fixation of $N_2$ by nitrogenase, and a nodule-enhanced MDH is thus critical for nodule function.

Phosphoenolpyruvate carboxylase (PEPC) catalyses the reaction of phosphoenol-pyruvate with $HCO_3^-$ releasing the phosphate and producing the C4 product, oxaloacetate. Oxaloacetate is commonly reduced to malate by NADH through the action of malate dehydrogenase (MDH). PEPC is a homotetrameric enzyme widely distributed in most plant tissues. In plants, PEPC fulfills various physiological roles such as the photosynthetic $CO_2$ fixation in $C_4$ and Crassulacean Acid Metabolism (CAM) plants, and the anaplerotic pathway.

While nucleic acid sequences encoding some organic acid biosynthetic enzymes have been isolated for certain species of plants, there remains a need for materials useful in modifying organic acid biosynthesis; in modifying organic acid secretion; in modifying phosphorus acquisition efficiency in plants; in modifying aluminium and acid soil tolerance in plants; in modifying nitrogen fixation and nodule function, particularly in forage legumes and grasses, including alfalfa, medics, clovers, ryegrasses and fescues, and for methods for their use.

This invention is directed towards overcoming, or at least alleviating, one or more of the difficulties or deficiencies associated with the prior art.

In one aspect, the present invention provides substantially purified or isolated nucleic acids or nucleic acid fragments encoding the organic acid biosynthetic polypeptides CS, MDH and PEPC, from a clover (*Trifolium*), medic (*Medicago*), ryegrass (*Lolium*) or fescue (*Festuca*) species, or functionally active fragments or variants of these polypeptides.

The present invention also provides substantially purified or isolated nucleic acids or nucleic acid fragments encoding amino acid sequences for a class of polypeptides which are related to CS, MDH and PEPC (from a clover (*Trifolium*), medic (*Medicago*), ryegrass (*Lolium*) or fescue (*Festuca*)

species) of CS, MDH and PEPC, or functionally active fragments or variants of CS, MDH and PEPC. Such polypeptides are referred to herein as CS-like, MDH-like and PEPC-like respectively and include polypeptides having similar functional activity.

The present invention also relates to individual or simultaneous enhancement or otherwise manipulation of CS, MDH and/or PEPC or like gene activities in plants to enhance or otherwise alter organic acid biosynthesis; to enhance or reduce or otherwise alter organic acid secretion; to enhance or reduce or otherwise alter phosphorous acquisition efficiency in plants; to enhance or reduce or otherwise alter aluminium and acid soil tolerance in plants; and/or to enhance or reduce or otherwise alter nitrogen fixation and nodule function in legumes.

The individual or simultaneous enhancement or otherwise manipulation of CS, MDH and/or PEPC or like gene activities in plants has significant consequences for a range of applications in, for example, plant production, plant performance, plant nutrition and plant tolerance. For example, it has applications in increasing plant tolerance to aluminium-toxic acid soils; in improving plant nutrient acquisition efficiency for example in increasing acquisition of phosphorus from soils; in increasing nodule function in nitrogen-fixing legumes for example leading to enhanced nitrogen fixation; in modifying the accumulation of organic acids such as citrate in fruits; in modifying the secretion of organic acids for example citrate and/or malate from plant roots.

Manipulation of CS, MDH and/or PEPC or like gene activities in plants, including legumes such as clovers (*Trifolium* species), lucerne (*Medicago sativa*) and grass species such as ryegrasses (*Lolium* species) and fescues (*Festuca* species) may be used to facilitate the production of, for example, forage legumes and forage grasses and other crops with enhanced tolerance to aluminium toxic soils; enhanced nutrient acquisition efficiency; forage legumes with enhanced nitrogen fixation; fruits with enhanced organic acid content leading to enhanced flavour and health benefits.

The clover (*Trifolium*), medic (*Medicago*), ryegrass (*Lolium*) or fescue (*Festuca*) species may be of any suitable type, including white clover (*Trifolium repens*), red clover (*Trifolium pratense*), subterranean clover (*Trifolium subterraneum*), alfalfa (*Medicago sativa*), Italian or annual ryegrass (*Lolium multiflorum*), perennial ryegrass (*Lolium perenne*), tall fescue (*Festuca arundinacea*), meadow fescue (*Festuca pratelisis*) and red fescue (*Festuca rubra*). Preferably the species is a clover or a ryegrass, more preferably white clover (*T. repens*) or perennial ryegrass (*L. perenne*). White clover (*Trifolium repens* L.) and perennial ryegrass (*Lolium perenne* L.) are key pasture legumes and grasses, respectively, in temperate climates throughout the world. Perennial ryegrass is also an important turf grass.

The nucleic acid or nucleic acid fragment may be of any suitable type and includes DNA (such as cDNA or genomic DNA) and RNA (such as mRNA) that is single- or double-stranded, optionally containing synthetic, non-natural or altered nucleotide bases, and combinations thereof. The RNA is readily obtainable, for example, by transcription of a DNA sequence according to the present invention, to produce a RNA corresponding to the DNA sequence. The RNA may be synthesised in vivo or in vitro or by chemical synthesis to produce a sequence corresponding to a DNA sequence by methods well known in the art. In this specification, where the degree of sequence similarity between an RNA and DNA is such that the strand of the DNA could encode the RNA, then the RNA is said to "correspond" to that DNA.

The term "isolated" means that the material is removed from its original environment (eg. the natural environment if it is naturally occurring). For example, a naturally occurring nucleic acid or polypeptide present in a living plant is not isolated, but the same nucleic acid or polypeptide separated from some or all of the coexisting materials in the natural system, is isolated. Such an isolated nucleic acid could be part of a vector and/or such a nucleic acid could be part of a composition, and still be isolated in that such a vector or composition is not part of its natural environment. An isolated polypeptide could be part of a composition and still be isolated in that such a composition is not part of its natural environment.

By "functionally active" in respect of a nucleic acid it is meant that the fragment or variant is capable of modifying organic acid biosynthesis in a plant. A variant in this context can be an analogue, derivative or mutant and includes naturally occurring allelic variants and non-naturally occurring variants. Additions, deletions, substitutions and derivatizations of one or more of the nucleotides are contemplated so long as the modifications do not result in loss of functional activity of the fragment or variant. Preferably the functionally active fragment or variant has at least approximately 80% identity to the functional part of the above mentioned sequence, more preferably at least approximately 90% identity, most preferably at least approximately 95% identity. Such functionally active variants and fragments include, for example, those having nucleic acid changes which result in conservative amino acid substitutions of one or more residues in the corresponding amino acid sequence. Preferably the fragment has a size of at least 30 nucleotides, more preferably at least 45 nucleotides, most preferably at least 60 nucleotides.

By "functionally active" in respect of a polypeptide it is meant that the fragment or variant has one or more of the biological properties of the proteins CS, CS-like, MDH, MDH-like, PEPC and PEPC-like. A variant in this context includes additions, deletions, substitutions and derivatizations of one or more of the amino acids are contemplated so long as the modifications do not result in loss of functional activity of the fragment or variant. Preferably the functionally active fragment or variant has at least approximately 60% identity to the functional part of the above mentioned sequence, more preferably at least approximately 80% identity, most preferably at least approximately 90% identity. Such functionally active variants and fragments include, for example, those having conservative amino acid substitutions of one or more residues in the corresponding amino acid sequence. Preferably the fragment has a size of at least 10 amino acids, more preferably at least 15 amino acids, most preferably at least 20 amino acids.

The term "construct" as used herein refers to an artificially assembled or isolated nucleic acid molecule which includes the gene of interest. In general a construct may include the gene or genes of interest, a marker gene which in some cases can also be the gene of interest and appropriate regulatory sequences. It should be appreciated that the inclusion of regulatory sequences in a construct is optional, for example, such sequences may not be required in situations where the regulatory sequences of a host cell are to be used. The term construct includes vectors but should not be seen as being limited thereto.

The term "vector" as used herein encompasses both cloning and expression vectors. Vectors are often recombinant molecules containing nucleic acid molecules from several sources.

By "operatively linked" in respect of a regulatory element, nucleic acid or nucleic acid fragment and terminator, is meant that the regulatory element is capable of causing expression of said nucleic acid or nucleic acid fragment in a plant cell and said terminator is capable of terminating expression of said nucleic acid or nucleic acid fragment in a plant cell. Preferably, said regulatory element is upstream of said nucleic acid or nucleic acid fragment and said terminator is downstream of said nucleic acid or nucleic acid fragment.

By "an effective amount" of a nucleic acid or nucleic acid fragment is meant an amount sufficient to result in an identifiable phenotypic trait in said plant, or a plant, plant seed or other plant part derived therefrom. Such amounts can be readily determined by an appropriately skilled person, taking into account the type of plant, the route of administration and other relevant factors. Such a person will readily be able to determine a suitable amount and method of administration. See, for example, Maniatis et al, Molecular Cloning: A Laboratory Manual, Cold Spring Harbor Laboratory, Cold Spring Harbor, the entire disclosure of which is incorporated herein by reference.

It will also be understood that the term "comprises" (or its grammatical variants) as used in this specification is equivalent to the term "includes" and should not be taken as excluding the presence of other elements or features.

Such nucleic acids or nucleic acid fragments could be assembled to form a consensus contig. As used herein, the term "consensus contig" refers to a nucleotide sequence that is assembled from two or more constituent nucleotide sequences that share common or overlapping regions of sequence homology. For example, the nucleotide sequence of two or more nucleic acids or nucleic acid fragments can be compared and aligned in order to identify common or overlapping sequences. Where common or overlapping sequences exist between two or more nucleic acids or nucleic acid fragments, the sequences (and thus their corresponding nucleic acids or nucleic acid fragments) can be assembled into a single contiguous nucleotide sequence.

In a preferred embodiment of this aspect of the invention, the substantially purified or isolated nucleic acid or nucleic acid fragment encodes a CS or CS-like polypeptide and including a nucleotide sequence selected from the group consisting of (a) sequences shown in SEQ ID NOS 1, 3 to 10, 11, 13 to 16, 17, 19, 327, 329 to 335, 336, 338 to 344, 349, 351 and 353; (b) complements of the sequences recited in (a); (c) sequences antisense to the sequences recited in (a) and (b); (d) functionally active fragments and variants of the sequences recited in (a), (b) and (c); and (e) RNA sequences corresponding to the sequences recited in (a), (b), (c) and (d).

In a further preferred embodiment of this aspect of the invention, the substantially purified or isolated nucleic acid or nucleic acid fragment encodes a MDH or MDH-like polypeptide and including a nucleotide sequence selected from the group consisting of (a) sequence shown in SEQ ID NOS. 21, 23 to 29; 30, 32 to 33, 34, 36, 38, 40, 42 to 43, 44, 46, 48 to 110, 111, 113, 115, 117 to 182, 183, 185, 205, 207 to 217, 218, 220 to 251, 252, 254 to 270, 271, 273 to 275, 276, 278 to 287, 288, 290 to 292, 293, 295 to 296, 297, 299 to 301, 304 to 305, 306 and 308; (b) complements of the sequences recited in (a); (c) sequences antisense to the sequences recited in (a) and (b); (d) functionally active fragments and variants of the sequences recited in (a), (b) and (c); and (e) RNA sequences corresponding to the sequences recited in (a), (b), (c) and (d).

In a further preferred embodiment of this aspect of the invention, the substantially purified or isolated nucleic acid or nucleic acid fragment encodes a PEPC or PEPC-like polypeptide and including a nucleotide sequence selected from the group consisting of (a) sequences shown in SEQ ID NOS 187, 189, 191 to 197, 199, 201, 203, 310, 312 to 314, 315, 317 to 318, 319, 321 to 322, 323, 325 and 347; (b) complements of the sequences recited in (a); (c) sequences antisense to the sequences recited in (a) and (b); (d) functionally active fragments and variants of the sequences recited in (a), (b) and (c); and (e) RNA sequences corresponding to the sequences recited in (a), (b), (c) and (d).

Nucleic acids or nucleic acid fragments encoding at least a portion of several CS, MDH and PEPC polypeptides have been isolated and identified. Genes encoding other CS or CS-like, MDH or MDH-like and PEPC or PEPC-like proteins, either as cDNAs or genomic DNAs, may be isolated directly by using all or a portion of the nucleic acids or nucleic acid fragments of the present invention as hybridisation probes to screen libraries from the desired plant employing the methodology well known to those skilled in the art. Specific oligonucleotide probes based upon the nucleic acid sequences of the present invention may be designed and synthesized by methods known in the art. Moreover, the entire sequences may be used directly to synthesize DNA probes by methods known to the skilled artisan such as random primer DNA labelling, nick translation, or end-labelling techniques, or RNA probes using available in vitro transcription systems. In addition, specific primers may be designed and used to amplify a part or all of the sequences of the present invention. The resulting amplification products may be labelled directly during amplification reactions or labelled after amplification reactions, and used as probes to isolate full-length cDNA or genomic fragments under conditions of appropriate stringency.

In addition, short segments of the nucleic acids or nucleic acid fragments of the present invention may be used in protocols to amplify longer nucleic acids or nucleic acid fragments encoding homologous genes from DNA or RNA. For example, polymerase chain reaction may be performed on a library of cloned nucleic acid fragments wherein the sequence of one primer is derived from the nucleic acid sequences of the present invention, and the sequence of the other primer takes advantage of the presence of the polyadenylic acid tracts to the 3' end of the mRNA precursor encoding plant genes. Alternatively, the second primer sequence may be based upon sequences derived from the cloning vector. For example, those skilled in the art can follow the RACE protocol (Frohman et al. (1988) *Proc. Natl. Acad Sci. USA* 85:8998, the entire disclosure of which is incorporated herein by reference) to generate cDNAs by using PCR to amplify copies of the region between a single point in the transcript and the 3' or 5' end. Using commercially available 3' RACE and 5' RACE systems (BRL), specific 3' or 5' cDNA fragments may be isolated (Ohara et al. (1989) *Proc. Natl. Acad Sci USA* 86:5673; Loh et al. (1989) *Science* 243:217, the entire disclosures of which are incorporated herein by reference). Products generated by the 3' and 5' RACE procedures may be combined to generate full-length cDNAs.

In a further aspect of the present invention there is provided a substantially purified or isolated polypeptide from a clover (*Trifolium*), medic (*Medicago*), ryegrass (*Loliuni*) or fescue (*Festuca*) species, selected from the group consisting of CS or CS-like, MDH or MDH-like and PEPC or PEPC-like polypeptides; and functionally active fragments and variants of these polypeptides.

The clover (*Trifolium*), medic (*Medicago*), ryegrass (*Lolium*) or fescue (*Festuca*) species may be of any suitable type, including white clover (*Trifolium repens*), red clover (*Trifolium pratense*), subterranean clover (*Trifolium subterraneum*), alfalfa (*Medicago sativa*), Italian or annual ryegrass (*Lolium multiflorum*), perennial ryegrass (*Lolium perenne*), tall fescue (*Festuca arundinacea*), meadow fescue (*Festuca pratensis*) and red fescue (*Festuca rubra*). Preferably the species is a clover or a ryegrass, more preferably white clover (*T. repens*) or perennial ryegrass (*L. perenne*).

In a preferred embodiment of this aspect of the invention, the substantially purified or isolated CS or CS-like polypeptide includes an amino acid sequence selected from the group consisting of sequences shown in SEQ ID NOS 2, 12, 18, 20, 328, 337, 350, 352 and 354; and functionally active fragments and variants thereof.

In a further preferred embodiment of this aspect of the invention, the substantially purified or isolated MDH or MDH-like polypeptide includes an amino acid sequence selected from the group consisting of sequences shown in SEQ ID NOS 22, 31, 35, 37, 39, 41, 45, 47, 112, 114, 116, 184, 186, 206, 219, 253, 272, 277, 289, 294, 297, 303, 307 and 309; and functionally active fragments and variants thereof.

In a further preferred embodiment of this aspect of the invention, the substantially purified or isolated PEPC or PEPC-like polypeptide includes an amino acid sequence selected from the group consisting of sequences shown in SEQ ID NOS 188, 190, 198, 200, 202, 204, 311, 316, 320, 324, 326, and 348; and functionally active fragments and variants thereof.

In a further embodiment of this aspect of the invention, there is provided a polypeptide produced (e.g. recombinantly) from a nucleic acid or nucleic acid fragment according to the present invention. Techniques for recombinantly producing polypeptides are known to those skilled in the art.

Availability of the nucleotide sequences of the present invention and deduced amino acid sequences facilitates immunological screening of cDNA expression libraries. Synthetic peptides representing portions of the instant amino acid sequences may be synthesized. These peptides may be used to immunise animals to produce polyclonal or monoclonal antibodies with specificity for peptides and/or proteins including the amino acid sequences. These antibodies may be then used to screen cDNA expression libraries to isolate full-length cDNA clones of interest.

A genotype is the genetic constitution of an individual or group. Variations in genotype are important in commercial breeding programs, in determining parentage, in diagnostics and fingerprinting, and the like. Genotypes can be readily described in terms of genetic markers. A genetic marker identifies a specific region or locus in the genome. The more genetic markers, the finer defined is the genotype. A genetic marker becomes particularly useful when it is allelic between organisms because it then may serve to unambiguously identify an individual. Furthermore, a genetic marker becomes particularly useful when it is based on nucleic acid sequence information that can unambiguously establish a genotype of an individual and when the function encoded by such nucleic acid is known and is associated with a specific trait. Such nucleic acids and/or nucleotide sequence information including single nucleotide polymorphisms (SNPs), variations in single nucleotides between allelic forms of such nucleotide sequence, may be used as perfect markers or candidate genes for the given trait.

Applicants have identified a number of SNPs of the nucleic acids or nucleic acid fragments of the present invention. These are indicated (marked with grey on the black background) in the figures that show multiple alignments of nucleotide sequences of nucleic acid fragments contributing to consensus contig sequences. See for example, FIGS. 3, 6, 9, 13, 16, 30, 37, 57, 60, 63, 79, 89, 92 and 104 hereto.

Accordingly, in a further aspect of the present invention, there is provided a substantially purified or isolated nucleic acid or nucleic acid fragment including a single nucleotide polymorphism (SNP) from a nucleic acid or nucleic acid fragment according to the present invention, for example a SNP from a nucleic acid sequence shown in FIGS. 3, 6, 9, 13, 16, 30, 37, 57, 60, 63, 66, 67, 72, 78, 88, 94, 101 and 104 hereto; or complements or sequences antisense thereto, and functionally active fragments and variants thereof. The invention further provides a substantially purified or isolated nucleic acid or nucleic acid fragment including a single nucleotide polymorphism (SNP) isolated by the method of this invention.

In a still further aspect of the present invention there is provided a method of isolating a nucleic acid or nucleic acid fragment of the present invention including a SNP, said method including sequencing nucleic acid fragments from a nucleic acid library. The method includes the step of identifying the SNP.

The nucleic acid library may be of any suitable type and is preferably a cDNA library.

The nucleic acid or nucleic acid fragment may be isolated from a recombinant plasmid or may be amplified, for example using polymerase chain reaction.

The sequencing may be performed by techniques known to those skilled in the art.

In a still further aspect of the present invention, there is provided use of the nucleic acids or nucleic acid fragments of the present invention including SNPs, and/or nucleotide sequence information thereof, as molecular genetic markers.

In a still further aspect of the present invention there is provided use of a nucleic acid or nucleic acid fragment of the present invention, and/or nucleotide sequence information thereof, as a molecular genetic marker.

More particularly, nucleic acids or nucleic acid fragments according to the present invention and/or nucleotide sequence information thereof may be used as a molecular genetic marker for quantitative trait loci (QTL) tagging, QTL mapping, DNA fingerprinting and in marker assisted selection, particularly in clovers, alfalfa, ryegrasses and fescues. Even more particularly, nucleic acids or nucleic acid fragments according to the present invention and/or nucleotide sequence information thereof may be used as molecular genetic markers in plant improvement in relation to plant tolerance to abiotic stresses such aluminium toxic acid soils; in relation to nutrient acquisition efficiency including phosphorus; in relation to nitrogen fixation; in relation to nodulation. Even more particularly, sequence information revealing SNPs in allelic variants of the nucleic acids or nucleic acid fragments of the present invention and/or nucleotide sequence information thereof may be used as molecular genetic markers for QTL tagging and mapping and in marker assisted selection, particularly in clovers, alfalfa, ryegrasses and fescues.

In a still further aspect of the present invention there is provided a construct or vector including a nucleic acid or nucleic acid fragment according to the present invention.

In a particularly preferred embodiment the construct or vector may include nucleic acids or nucleic acid fragments encoding both CS or CS-like and MDH or MDH-like polypeptides.

In yet another preferred embodiment the construct or vector may include nucleic acids or nucleic acid fragments encoding both MDH or MDH-like and PEPC or PEPC-like polypeptides.

In yet another preferred embodiment the construct or vector may include both CS or CS-like and PEPC or PEPC-like polypeptides.

In another preferred embodiment the construct or vector may include nucleic acids or nucleic acid fragments encoding all three of CS or CS-like, MDH or MDH-like and PEPC or PEPC-like polypeptides.

In a preferred embodiment of this aspect of the invention, the vector may include one or more regulatory element such as a promoter, one or more nucleic acids or nucleic acid fragments according to the present invention and one or more terminators; said one or more regulatory elements, one or more nucleic acids or nucleic acid fragments and one or more terminators being operatively linked.

In a preferred embodiment of the present invention the vector may contain nucleic acids or nucleic acid fragments encoding both CS or CS-like and MDH or MDH-like polypeptides, operatively linked to a regulatory element or regulatory elements, such that both CS or CS-like and MDH or MDH-like polypeptides are expressed.

In another preferred embodiment of the present invention the vector may contain nucleic acids or nucleic acid fragments encoding both CS or CS-like and PEPC or PEPC-like polypeptides, operatively linked to a regulatory element or regulatory elements, such that both CS or CS-like and PEPC or PEPC-like polypeptides are expressed.

In yet another particularly preferred embodiment of the present invention the vector or construct may contain nucleic acids or nucleic acid fragments encoding both MDH or MDH-like and PEPC or PEPC-like polypeptides, operatively linked to a regulatory element or regulatory elements, such that both MDH or MDH-like and PEPC or PEPC-like polypeptides are expressed.

In another particularly preferred embodiment of the present invention the vector may contain nucleic acids or nucleic acid fragments encoding all three of CS or CS-like, MDH or MDH-like and PEPC or PEPC-like, operatively linked to a regulatory element or regulatory elements, such that all three of CS or CS-like, MDH or MDH-like and PEPC or PEPC-like polypeptides are expressed.

The vector may be of any suitable type and may be viral or non-viral. The vector may be an expression vector. Such vectors include chromosomal, non-chromosomal and synthetic nucleic acid sequences, eg. derivatives of plant viruses; bacterial plasmids; derivatives of the Ti plasmid from *Agrobacterium tumefaciens*, derivatives of the Ri plasmid from *Agrobacterium rhizogenes*; phage DNA; yeast artificial chromosomes; bacterial artificial chromosomes; binary bacterial artificial chromosomes; vectors derived from combinations of plasmids and phage DNA. However, any other vector may be used as long as it is replicable, integrative or viable in the plant cell.

The regulatory element and terminator may be of any suitable type and may be endogenous to the target plant cell or may be exogenous, provided that they are functional in the target plant cell.

Preferably the regulatory element is a promoter. A variety of promoters which may be employed in the vectors of the present invention are well known to those skilled in the art. Factors influencing the choice of promoter include the desired tissue specificity of the vector, and whether constitutive or inducible expression is desired and the nature of the plant cell to be transformed (eg. monocotyledon or dicotyledon). Particularly suitable constitutive promoters include the Cauliflower Mosaic Virus 35S (CaMV 35S) promoter, the maize Ubiquitin promoter, and the rice Actin promoter. Particularly suitable tissue-specific promoters include root-prevalent promoters.

A variety of terminators which may be employed in the vectors of the present invention are also well known to those skilled in the art. The terminator may be from the same gene as the promoter sequence or a different gene. Particularly suitable terminators are polyadenylation signals, such as the CaMV 35S polyA and other terminators from the nopaline synthase (nos) and the octopine synthase (ocs) genes.

The vector, in addition to the regulatory element, the nucleic acid or nucleic acid fragment of the present invention and the terminator, may include further elements necessary for expression of the nucleic acid or nucleic acid fragment, in different combinations, for example vector backbone, origin of replication (ori), multiple cloning sites, spacer sequences, enhancers, introns (such as the maize Ubiquitin Ubi intron), antibiotic resistance genes and other selectable marker genes [such as the neomycin phosphotransferase (npt2) gene, the hygromycin phosphotransferase (hph) gene, the phosphinothricin acetyltransferase (bar or pat) gene, the phospho-mannose isomerase (pmi) gene], and reporter genes (such as beta-glucuronidase (GUS) gene (gusA)]. The vector may also contain a ribosome binding site for translation initiation. The vector may also include appropriate sequences for amplifying expression.

As an alternative to use of a selectable marker gene to provide a phenotypic trait for selection of transformed host cells, the presence of the vector in transformed cells may be determined by other techniques well known in the art, such as PCR (polymerase chain reaction), Southern blot hybridisation analysis, histochemical GUS assays, northern and Western blot hybridisation analyses.

Those skilled in the art will appreciate that the various components of the vector are operatively linked, so as to result in expression of said nucleic acid or nucleic acid fragment. Techniques for operatively linking the components of the vector of the present invention are well known to those skilled in the art. Such techniques include the use of linkers, such as synthetic linkers, for example including one or more restriction enzyme sites.

The vectors of the present invention may be incorporated into a variety of plants, including monocotyledons (such as grasses from the genera *Lolium, Festuca, Paspalum, Pennisetum, Panicum* and other forage and turfgrasses, corn, oat, sugarcane, wheat and barley), dicotyledons (such as Arabidopsis, tobacco, clovers, medics, eucalyptus, potato, sugarbeet, canola, soybean, chickpea) and gymnosperms. In a preferred embodiment, the vectors may be used to transform monocotyledons, preferably grass species such as ryegrasses (*Lolium* species) and fescues (*Festuca* species), more preferably perennial ryegrass, including forage- and turf-type cultivars. In an alternate preferred embodiment, the vectors may be used to transform dicotyledons, preferably forage legume species such as clovers (*Trifolium* species) and medics (*Medicago* species), more preferably white clover (*Trifolium repens*), red clover (*Trifolium pratense*), subterranean clover (*Trifolium subterraneum*) and alfalfa (*Medicago sativa*). Clovers, alfalfa and medics are key pasture legumes in temperate climates throughout the world.

Techniques for incorporating the vectors of the present invention into plant cells (for example by transduction, transfection or transformation) are known to those skilled in the art. Such techniques include *Agrobacterium* mediated introduction, electroporation to tissues, cells and protoplasts, protoplast fusion, injection into reproductive organs, injection into immature embryos and high velocity projectile introduction to cells, tissues, calli, immature and mature embryos. The choice of technique will depend largely on the type of plant to be transformed.

Cells incorporating the vectors of the present invention may be selected, as described above, and then cultured in an appropriate medium to regenerate transformed plants, using techniques well known in the art. The culture conditions, such as temperature, pH and the like, will be apparent to the person skilled in the art. The resulting plants may be reproduced, either sexually or asexually, using methods well known in the art, to produce successive generations of transformed plants.

In a further aspect of the present invention there is provided a plant cell, plant, plant seed or other plant part, including, e.g. transformed with, a vector, nucleic acid or nucleic acid fragment of the present invention.

The plant cell, plant, plant seed or other plant part may be from any suitable species, including monocotyledons, dicotyledons and gymnosperms. In a preferred embodiment the plant cell, plant, plant seed or other plant part may be from a monocotyledon, preferably a grass species, more preferably a ryegrass (*Lolium* species) or fescue (*Festuca* species), more preferably perennial ryegrass, including both forage- and turf-type cultivars. In an alternate preferred embodiment the plant cell, plant, plant seed or other plant part may be from a dicotyledon, preferably forage legume species such as clovers (*Trifolium* species) and medics (*Medicago* species), more preferably white clover (*Trifolium repens*), red clover (*Trifolium pratense*), subterranean clover (*Trifoliun subterraneum*) and alfalfa (*Medicago sativa*).

The present invention also provides a plant, plant seed or other plant part, or a plant extract derived from a plant cell of the present invention.

The present invention also provides a plant, plant seed or other plant part, or a plant extract derived from a plant of the present invention.

In a further aspect of the present invention there is provided a method of modifying organic acid biosynthesis; of modifying organic acid secretion; of modifying phosphorous and other nutrients acquisition efficiency in plants; of modifying aluminium and acid soil tolerance in plants; of modifying nitrogen fixation and nodule function, said method including introducing into said plant an effective amount of a nucleic acid or nucleic acid fragment according to the present invention. Preferably the nucleic acid or nucleic acid fragment is part of a vector.

Using the methods and products of the present invention, organic acid biosynthesis; organic acid secretion; phosphorous and other plant nutrient acquisition efficiency; aluminium and acid soil tolerance; nitrogen fixation and nodule function, may be increased or otherwise altered, for example by incorporating additional copies of a sense nucleic acid or nucleic acid fragment of the present invention. They may be decreased or otherwise altered, for example by incorporating an antisense nucleic acid or nucleic acid fragment of the present invention.

In a particularly preferred embodiment the method may include introducing into said plant nucleic acids or nucleic acid fragments encoding both CS or CS-like and MDH or MDH-like polypeptides.

In another preferred embodiment the method may include introducing into said plant nucleic acids or nucleic acid fragments encoding both CS or CS-like and PEPC or PEPC polypeptides.

In yet another preferred embodiment the method may include introducing into said plant nucleic acids or nucleic acid fragments encoding both MDH or MDH-like and PEPC or PEPC-like polypeptides.

In an even more preferred embodiment the method may include introducing into said plant nucleic acids or nucleic acid fragments encoding all three of CS or CS-like, MDH or MDH-like and PEPC or PEPC-like polypeptides.

The present invention will now be more fully described with reference to the accompanying Examples and drawings. It should be understood, however, that the description following is illustrative only and should not be taken in any way as a restriction on the generality of the invention described above.

In the Figures and Sequences

SEQ ID NO. 1 shows the consensus contig nucleotide sequence of LpCSa.

SEQ ID NO. 2 shows the deduced amino acid sequence of LpCSa.

FIG. 1 shows the nucleotide sequences of the nucleic acid fragments contributing to the consensus contig sequence LpCSa.

SEQ ID NO. 11 shows the consensus contig nucleotide sequence of LpCSb.

SEQ ID NO. 12 shows the deduced amino acid sequence of LpCSb.

FIG. 2 shows the nucleotide sequences of the nucleic acid fragments contributing to the consensus contig sequence LpCSb.

SEQ ID NO. 17 shows the nucleotide sequence of LpCSc.

SEQ ID NO. 18 shows the deduced amino acid sequence of LpCSc.

SEQ ID NO. 19 shows the nucleotide sequence of LpCSd.

SEQ ID NO. 20 shows the deduced amino acid sequence of LpCSd.

SEQ ID NO. 21 shows the consensus contig nucleotide sequence of LpMDHa.

SEQ ID NO. 22 shows the deduced amino acid sequence of LpMDHa.

FIG. 3 shows the nucleotide sequences of the nucleic acid fragments contributing to the consensus contig sequence LpMDHa.

SEQ ID NO. 30 shows the consensus contig nucleotide sequence of LpMDHb.

SEQ ID NO. 31 shows the deduced amino acid sequence of LpMDHb.

FIG. 4 shows the nucleotide sequences of the nucleic acid fragments contributing to the consensus contig sequence LpMDHb.

SEQ ID NO. 34 shows the nucleotide sequence of LpMDHc.

SEQ ID NO. 35 shows the deduced amino acid sequence of LpMDHc.

SEQ ID NO. 36 shows the nucleotide sequence of LpMDHd.

SEQ ID NO. 37 shows the deduced amino acid sequence of LpMDHd.

SEQ ID NO. 38 shows the nucleotide sequence of LpMDHe.

SEQ ID NO. 39 shows the deduced amino acid sequence of LpMDHe.

SEQ ID NO. 40 shows the consensus contig nucleotide sequence of LpMDHf.

SEQ ID NO. 41 shows the deduced amino acid sequence of LpMDHf.

FIG. 5 shows the nucleotide sequences of the nucleic acid fragments contributing to the consensus contig sequence LpMDHf.

SEQ ID NO. 44 shows the nucleotide sequence of LpMDHg.

SEQ ID NO. 45 shows the deduced amino acid sequence of LpMDHg.

SEQ ID NO. 46 shows the consensus contig nucleotide sequence of LpMDHh.

SEQ ID NO. 47 shows the deduced amino acid sequence of LpMDHh.

FIG. 6 shows the nucleotide sequences of the nucleic acid fragments contributing to the consensus contig sequence LpMDHh.

SEQ ID NO. 111 shows the nucleotide sequence of LpMDHi.

SEQ ID NO. 112 shows the deduced amino acid sequence of LpMDHi.

SEQ ID NO. 113 shows the nucleotide sequence of LpMDHj.

SEQ ID NO. 114 shows the deduced amino acid sequence of LpMDHj.

SEQ ID NO. 115 shows the consensus contig nucleotide sequence of LpMDHk.

SEQ ID NO. 116 shows the deduced amino acid sequence of LpMDHk.

Figure 7:
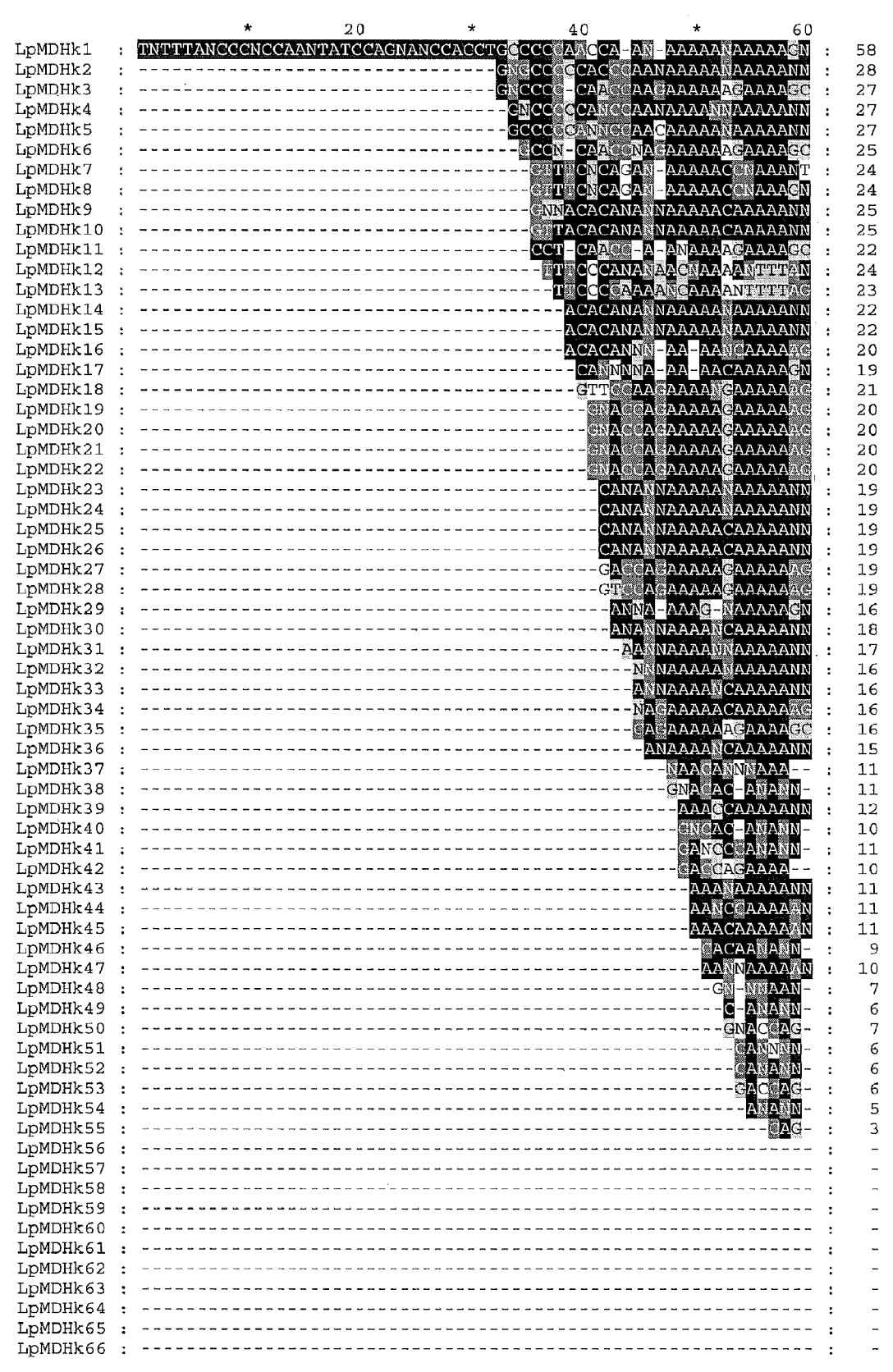
Figure 7:
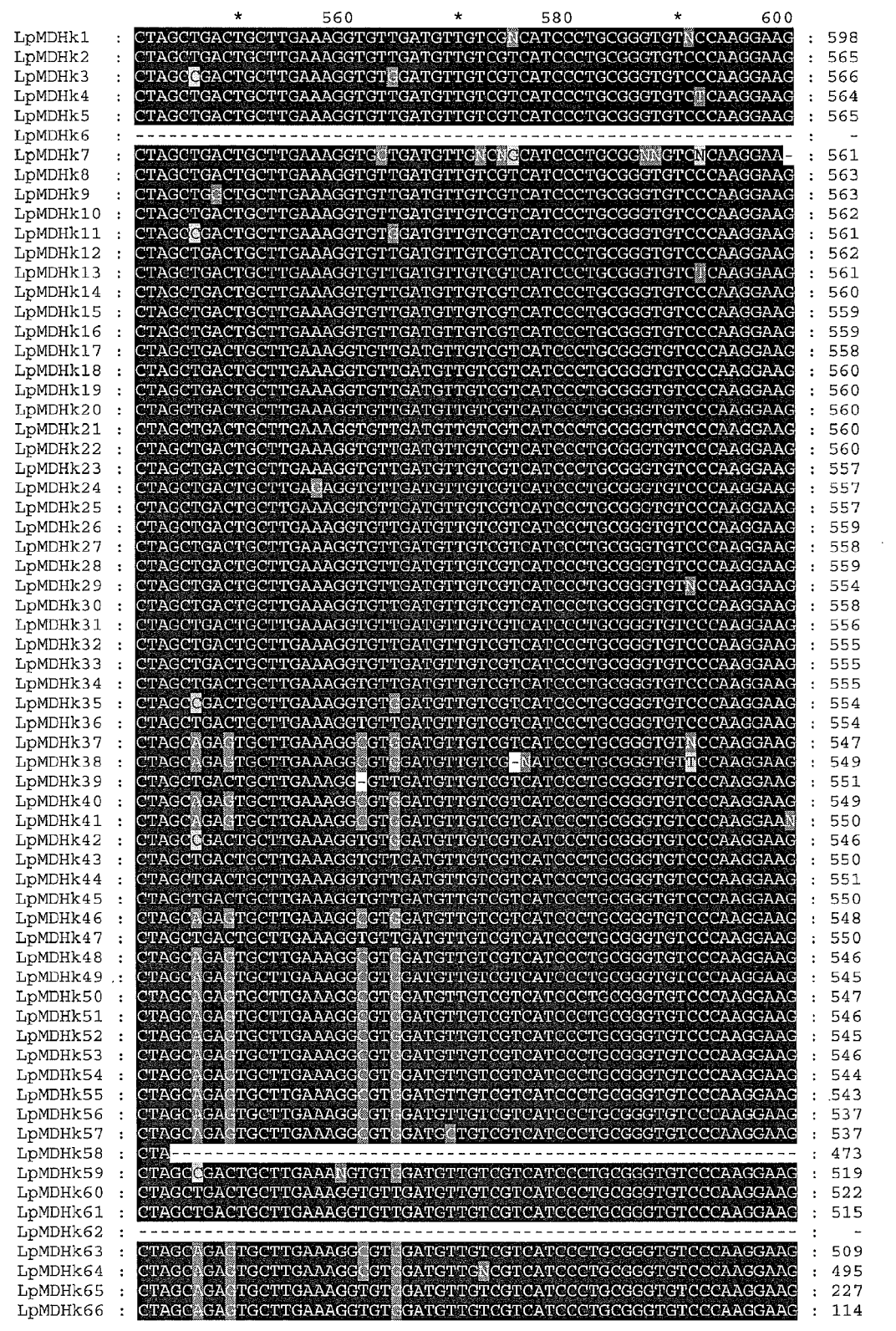

FIG. 7 shows the nucleotide sequences of the nucleic acid fragments contributing to the consensus contig sequence LpMDHk.

SEQ ID NO. 183 shows the nucleotide sequence of LpMDHl.

SEQ ID NO. 184 shows the deduced amino acid sequence of LpMDHl.

SEQ ID NO. 185 shows the nucleotide sequence of LpMDHm.

SEQ ID NO. 186 shows the deduced amino acid sequence of LpMDHm.

SEQ ID NO. 187 shows the nucleotide sequence of LpPEPCa.

SEQ ID NO. 188 shows the deduced amino acid sequence of LpPEPCa.

SEQ ID NO. 189 shows the consensus contig nucleotide sequence of LpPEPCb.

SEQ ID NO. 190 shows the deduced amino acid sequence of LpPEPCb.

FIG. 8 shows the nucleotide sequences of the nucleic acid fragments contributing to the consensus contig sequence LpPEPCb.

SEQ ID NO. 197 shows the nucleotide sequence of LpPEPCc.

SEQ ID NO. 198 shows the deduced amino acid sequence of LpPEPCc.

SEQ ID NO. 199 shows the nucleotide sequence of LpPEPCd.

SEQ ID NO. 200 shows the deduced amino acid sequence of LpPEPCd.

SEQ ID NO. 201 shows the nucleotide sequence of LpPEPCe.

SEQ ID NO. 202 shows the deduced amino acid sequence of LpPEPCe.

SEQ ID NO. 203 shows the nucleotide sequence of LpPEPCf.

SEQ ID NO. 204 shows the deduced amino acid sequence of LpPEPCf.

SEQ ID NO. 205 shows the consensus contig nucleotide sequence of TrMDHa.

SEQ ID NO. 206 shows the deduced amino acid sequence of TrMDHa.

Figure 9:
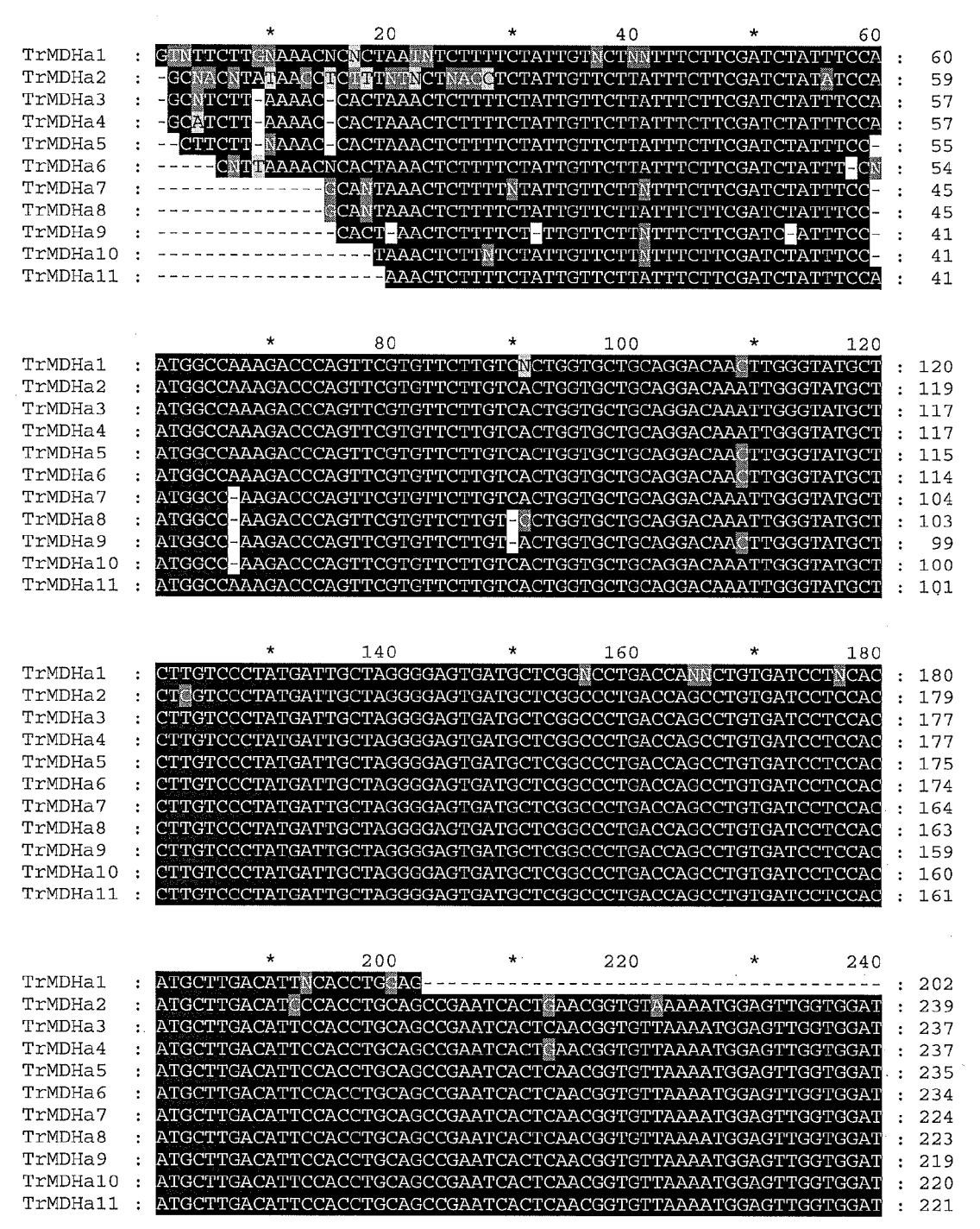

FIG. 9 shows the nucleotide sequences of the nucleic acid fragments contributing to the consensus contig sequence TrMDHa.

SEQ ID NO. 218 shows the consensus contig nucleotide sequence of TrMDHb.

SEQ ID NO. 219 shows the deduced amino acid sequence of TrMDHb.

FIG. 10 shows the nucleotide sequences of the nucleic acid fragments contributing to the consensus contig sequence TrMDHb.

SEQ ID NO. 252 shows the consensus contig nucleotide sequence of TrMDHc.

SEQ ID NO. 253 shows the deduced amino acid sequence of TrMDHc.

Figure 11:
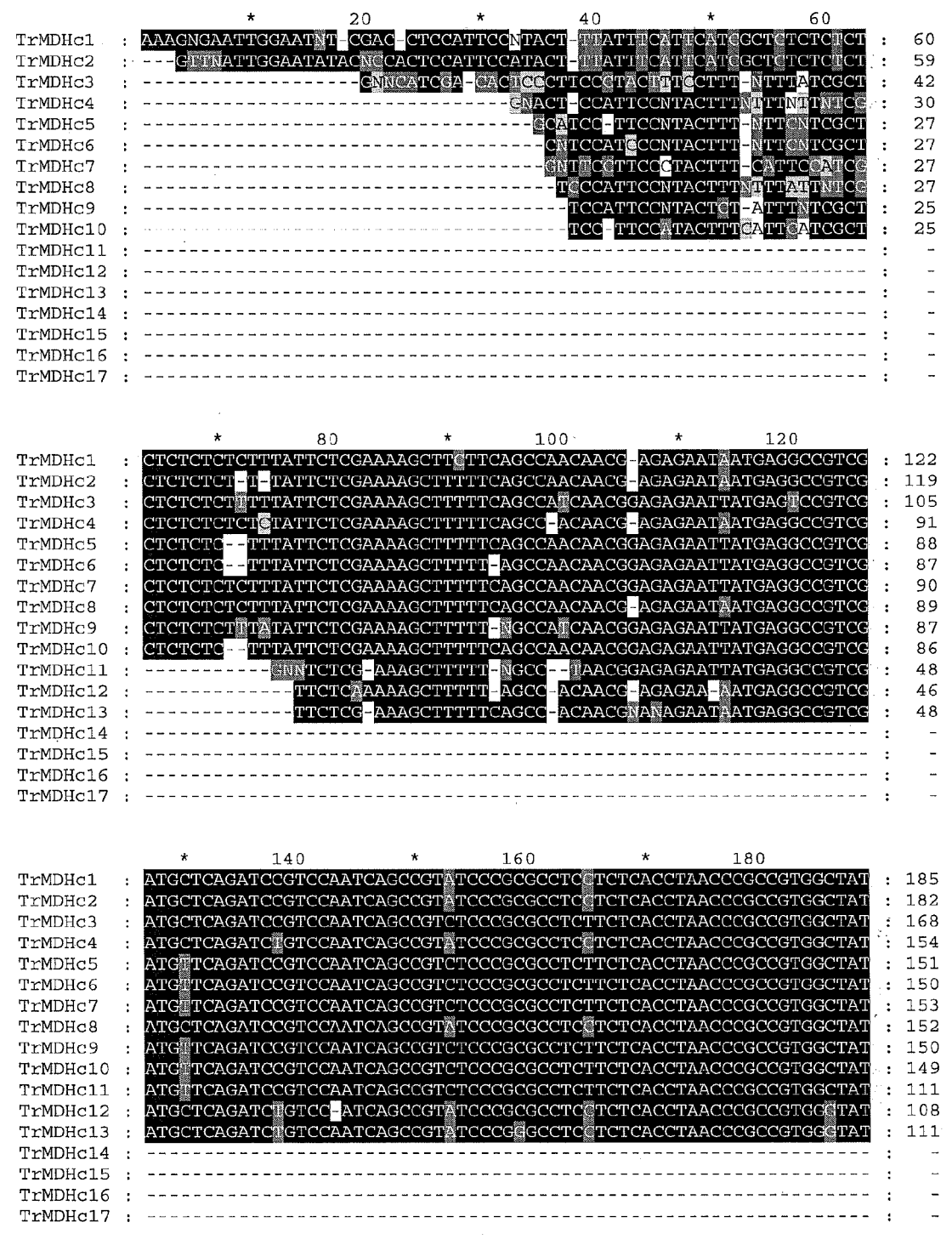

FIG. 11 shows the nucleotide sequences of the nucleic acid fragments contributing to the consensus contig sequence TrMDHc.

SEQ ID NO. 271 shows the consensus contig nucleotide sequence of TrMDHd.

SEQ ID NO. 272 shows the deduced amino acid sequence of TrMDHd.

FIG. 12 shows the nucleotide sequences of the nucleic acid fragments contributing to the consensus contig sequence TrMDHd.

SEQ ID NO. 276 shows the consensus contig nucleotide sequence of TrMDHe.

SEQ ID NO. 277 shows the deduced amino acid sequence of TrMDHe.

FIG. 13 shows the nucleotide sequences of the nucleic acid fragments contributing to the consensus contig sequence TrMDHe.

SEQ ID NO. 288 shows the consensus contig nucleotide sequence of TrMDHf.

SEQ ID NO. 289 shows the deduced amino acid sequence of TrMDHf.

FIG. 14 shows the nucleotide sequences of the nucleic acid fragments contributing to the consensus contig sequence TrMDHf.

SEQ ID NO. 293 shows the consensus contig nucleotide sequence of TrMDHg.

SEQ ID NO. 294 shows the deduced amino acid sequence of TrMDHg.

FIG. 15 shows the nucleotide sequences of the nucleic acid fragments contributing to the consensus contig sequence TrMDHg.

SEQ ID NO. 297 shows the consensus contig nucleotide sequence of TrMDHh.

SEQ ID NO. 298 shows the deduced amino acid sequence of TrMDHh.

FIG. 16 shows the nucleotide sequences of the nucleic acid fragments contributing to the consensus contig sequence TrMDHh.

SEQ ID NO. 302 shows the consensus contig nucleotide sequence of TrMDHi.

SEQ ID NO. 303 shows the deduced amino acid sequence of TrMDHi.

FIG. 17 shows the nucleotide sequences of the nucleic acid fragments contributing to the consensus contig sequence TrMDHi.

SEQ ID NO. 306 shows the nucleotide sequence of TrMDHj.

SEQ ID NO. 307 shows the deduced amino acid sequence of TrMDHj.

SEQ ID NO. 308 shows the nucleotide sequence of TrMDHk.

SEQ ID NO. 309 shows the deduced amino acid sequence of TrMDHk.

SEQ ID NO. 310 shows the consensus contig nucleotide sequence of TrPEPCa.

SEQ ID NO. 311 shows the deduced amino acid sequence of TrPEPCa.

FIG. 18 shows the nucleotide sequences of the nucleic acid fragments contributing to the consensus contig sequence TrPEPCa.

SEQ ID NO. 315 shows the consensus contig nucleotide sequence of TrPEPCb.

SEQ ID NO. 316 shows the deduced amino acid sequence of TrPEPCb.

FIG. 19 shows the nucleotide sequences of the nucleic acid fragments contributing to the consensus contig sequence TrPEPCb.

SEQ ID NO. 319 shows the consensus contig nucleotide sequence of TrPEPCc.

SEQ ID NO. 320 shows the deduced amino acid sequence of TrPEPCc.

FIG. 20 shows the nucleotide sequences of the nucleic acid fragments contributing to the consensus contig sequence TrPEPCc.

SEQ ID NO. 323 shows the nucleotide sequence of TrPEPCd.

SEQ ID NO. 324 shows the deduced amino acid sequence of TrPEPCd.

SEQ ID NO. 325 shows the nucleotide sequence of TrPEPCe.

SEQ ID NO. 326 shows the deduced amino acid sequence of TrPEPCe.

SEQ ID NO. 327 shows the consensus contig nucleotide sequence of TrCSa.

SEQ ID NO. 328 shows the deduced amino acid sequence of TrCSa.

FIG. 21 shows the nucleotide sequences of the nucleic acid fragments contributing to the consensus contig sequence TrCSa.

SEQ ID NO. 336 shows the consensus contig nucleotide sequence of TrCSb.

SEQ ID NO. 337 shows the deduced amino acid sequence of TrCSb.

FIG. 22 shows the nucleotide sequences of the nucleic acid fragments contributing to the consensus contig sequence TrCSb.

SEQ ID NO. 345 shows the nucleotide sequence of TrMDH.

SEQ ID NO. 346 shows the deduced amino acid sequence of TrMDH.

Figure 23:
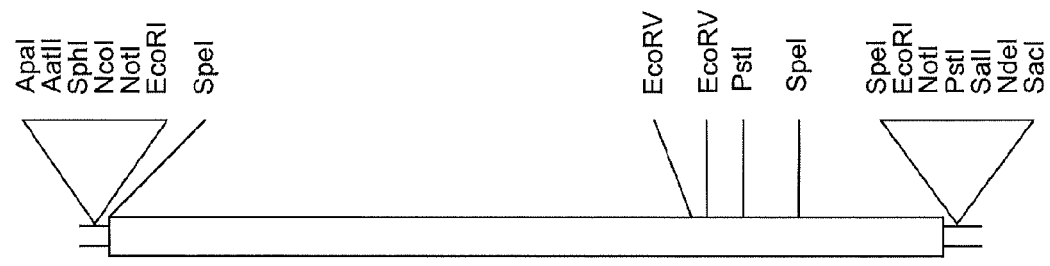
FIG. 23 shows the plasmid map in pGEM-T Easy of TrMDH.
Figure 24:
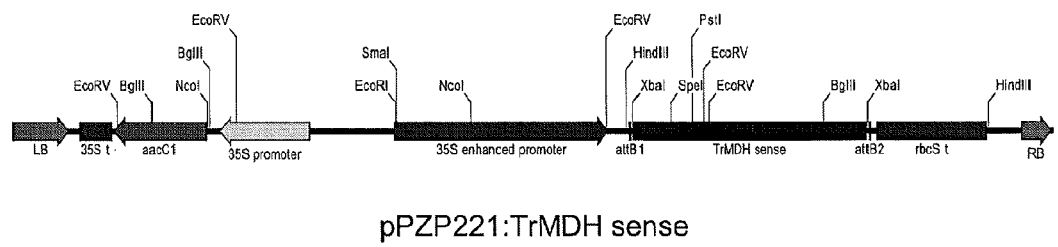

FIG. 24 shows the plasmid map of sense construct of TrMDH in the binary vector pPZP221:35S$^2$.

Figure 25:
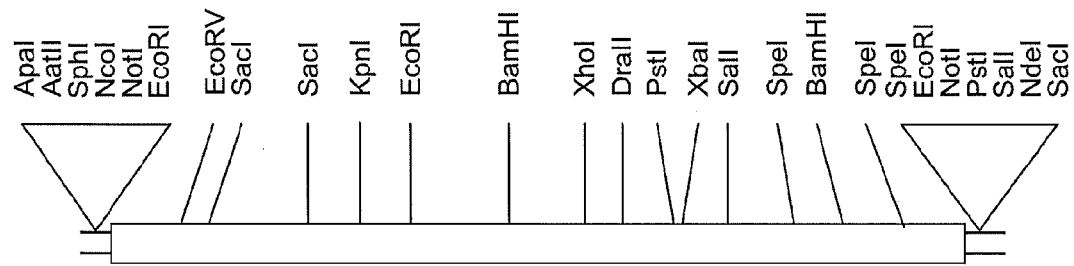

FIG. 25 shows the plasmid map in pGEM-T Easy of TrPEPC.

SEQ ID NO. 347 shows the nucleotide sequence of TrPEPC.

SEQ ID NO. 348 shows the deduced amino acid sequence of TrPEPC.

Figure 26:
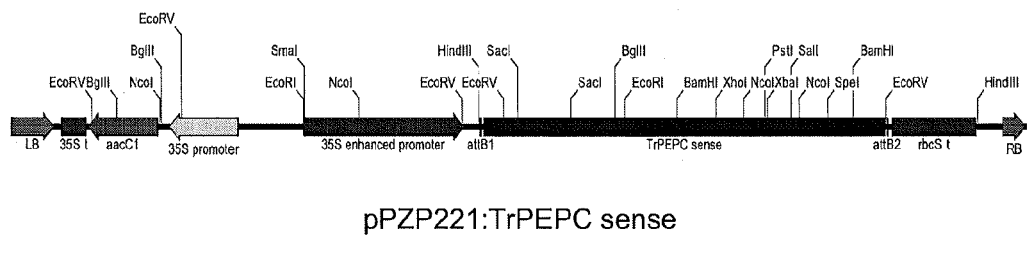

FIG. 26 shows the plasmid map of sense construct of TrPEPC in the binary vector pPZP221:35S$^2$.

Figure 27:
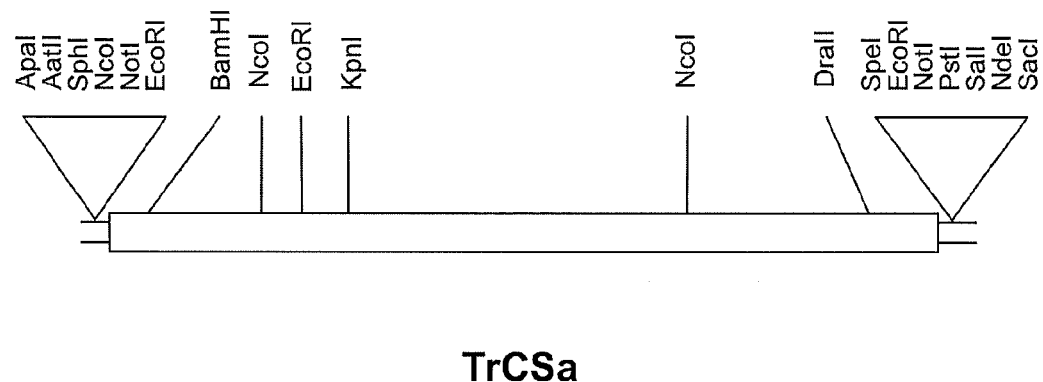

FIG. 27 shows the plasmid map in pGEM-T Easy of TrCSa.

SEQ ID NO. 349 shows the nucleotide sequence of TrCSa.

SEQ ID NO. 350 shows the deduced amino acid sequence of TrCSa.

Figure 28:
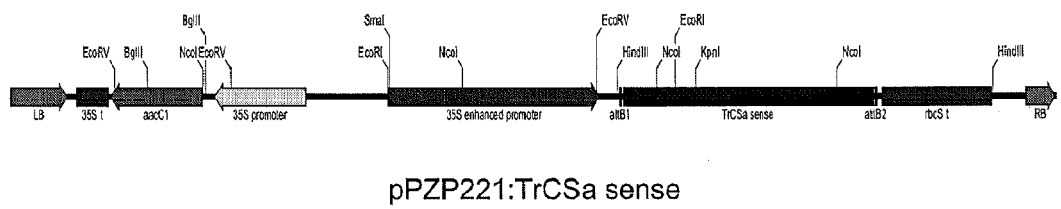

FIG. 28 shows the plasmid map of sense construct of TrCSa in the binary vector pPZP221:35S$^2$.

Figure 29:
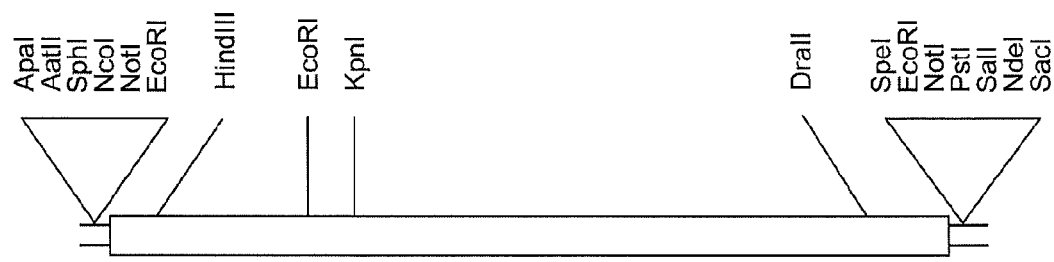

FIG. 29 shows the plasmid map in pGEM-T Easy of TrCSb.

SEQ ID NO. 351 shows the nucleotide sequence of TrCSb.

SEQ ID NO. 352 shows the deduced amino acid sequence of TrCSb.

Figure 30:
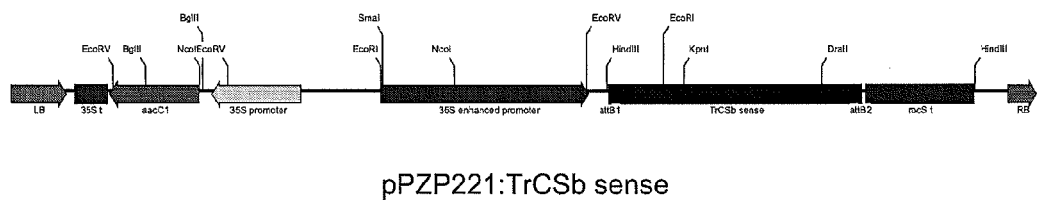

FIG. 30 shows the plasmid map of sense construct of TrCSb in the binary vector pPZP221:35S$^2$.

Figure 31:
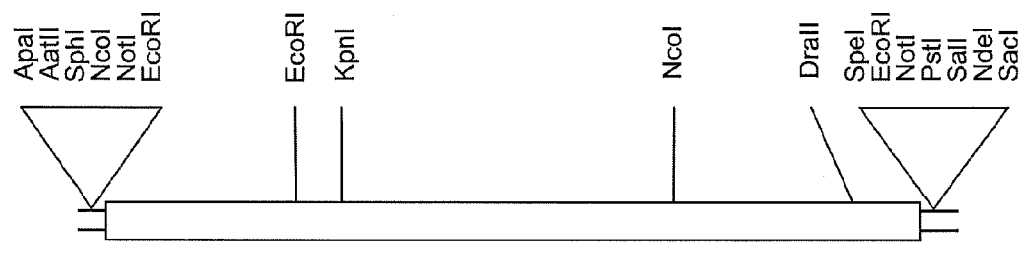

FIG. 31 shows the plasmid map in pGEM-T Easy of TrCSd.

SEQ ID NO. 353 shows the nucleotide sequence of TrCSd.

SEQ ID NO. 354 shows the deduced amino acid sequence of TrCSd.

Figure 32:

FIG. 32 shows the plasmid map of sense construct of TrCSd in the binary vector pPZP221:35S$^2$.

Figure 33:
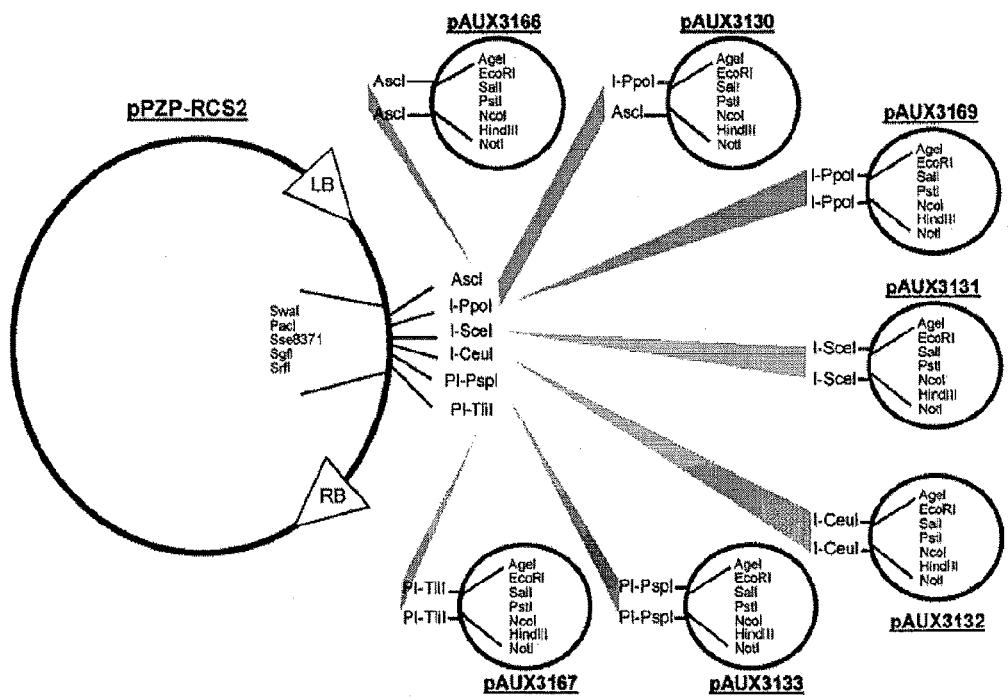

FIG. 33 shows the plasmid maps of the modular vector system comprising a binary base vector and 7 auxiliary vectors.

Figure 34:
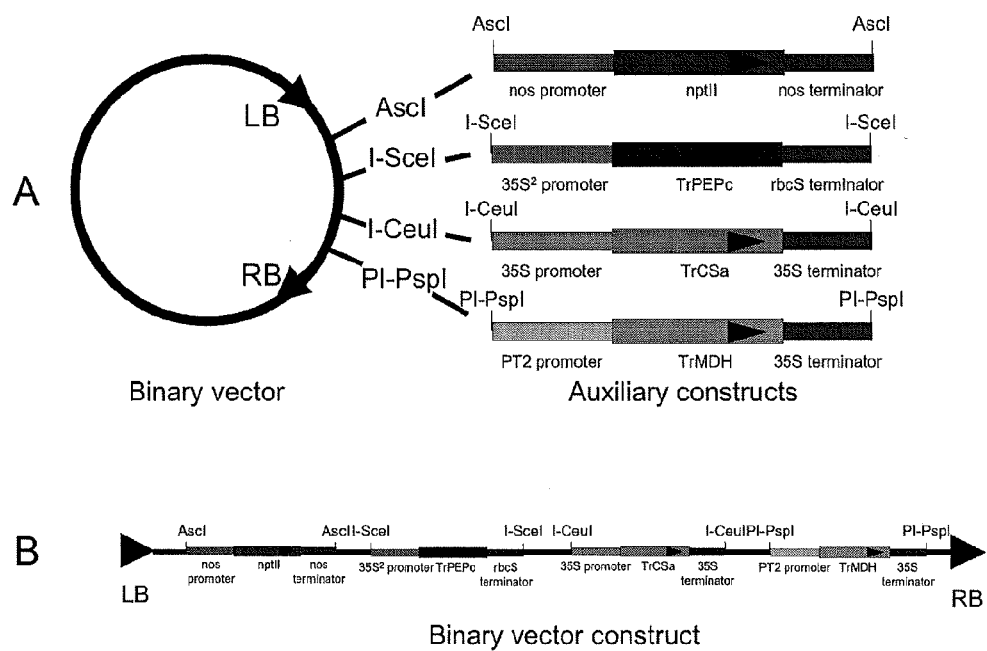

FIG. 34 shows an example of the modular binary transformation vector system comprising plasmid maps of the binary transformation vector backbone and 4 expression cassettes for combinatorial expression of chimeric CS and MDH and PEPC genes in auxiliary vectors (A) and the plasmid map of the T-DNA region of the final binary transformation vector (B).

FIG. 35 shows the results of RT-PCR experiments performed as described in Example 6. Samples were isolated from: L, leaf; S, stolon; St, stolon tip; R, root; Rt, root tip. −C: negative (no reverse transcriptase) control; +C, positive (plasmid) control. The numbers indicate cycle numbers. A: phosphate transporter homolog; B: root iron transporter homolog.

FIG. 36 shows the screening of a white clover BAC library using the phosphate transporter cDNA as a probe (A); Southern hybridisation blot of six BAC clones identified in A using the same probe (B); physical map of the phosphate transporter genomic region including the coding region and the promoter region (C).

Figure 37:
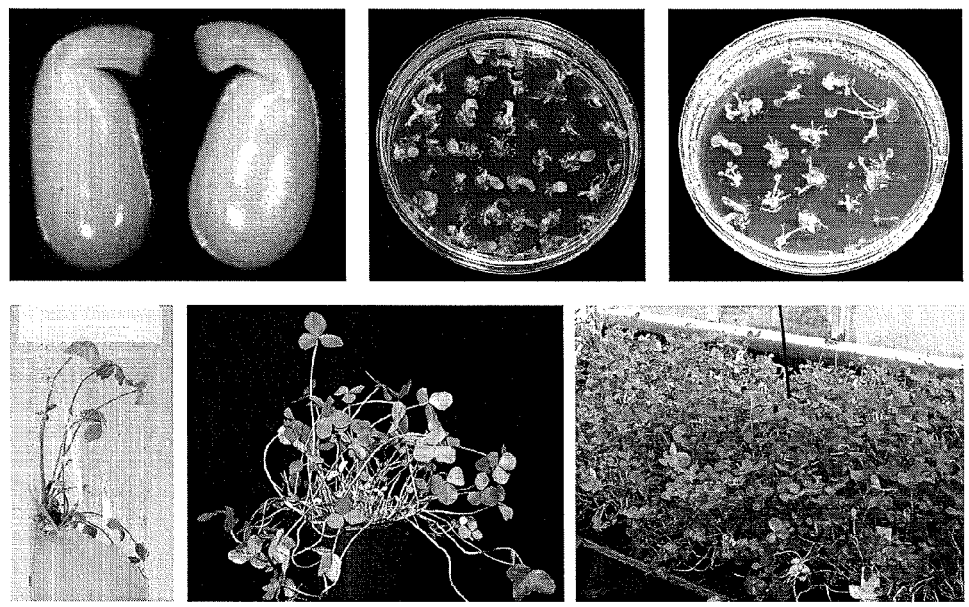

FIG. 37 shows white clover cotyledons, various stages of selection of plantlets transformed with a binary transformation vector constructed as described in Examples 4 and 5, transgenic white clover on root-inducing medium, and white clover plants transformed with genes involved in organic acid biosynthesis.

FIG. 38 shows the molecular analysis of transgenic white clover plants for the presence of the chimeric MDH gene with real time PCR amplification plot and agarose gel of PCR product.

FIG. 39 shows the molecular analysis of transgenic white clover plants for the presence of the chimeric PEPC gene with real time PCR amplification plot and agarose gel of PCR product.

FIG. 40 shows the molecular analysis of transgenic white clover plants for the presence of the chimeric CS gene with real time PCR amplification plot and agarose gel of PCR product.

EXAMPLE 1

Preparation of cDNA Libraries, Isolation and Sequencing of cDNAs Coding for CS, CS-Like, MDH, MDH-Like, PEPC and PEPC-Like Polypeptides from White Clover (*Trifolium repens*) and Perennial Ryegrass (*Lolium perenne*)

cDNA libraries representing mRNAs from various organs and tissues of white clover (*Trifolium repens*) and perennial ryegrass (*Lolium perenne*) were prepared. The characteristics of the white clover and perennial ryegrass libraries, respectively, are described below (Tables 1 and 2).

TABLE 1 cDNA libraries from white clover (*Trifolium repens*)

| Library | Organ/Tissue |
|---|---|
| 01wc | Whole seedling, light grown |
| 02wc | Nodulated root 3, 5, 10, 14, 21 & 28 day old seedling |

TABLE 1-continued cDNA libraries from white clover (*Trifolium repens*)

| Library | Organ/Tissue |
|---|---|
| 03wc | Nodules pinched off roots of 42 day old *rhizobium* inoculated white clover |
| 04wc | Nodulated white clover cut leaf and stem collected after 0, 1, 4, 6 & 14 h after cutting |
| 05wc | Non-nodulated Inflorescences: <50% open, not fully open and fully open |
| 06wc | Dark grown etiolated |
| 07wc | Inflorescence - very early stages, stem elongation, <15 petals, 15–20 petals |
| 08wc | seed frozen at −80° C., imbibed in dark overnight at 10° C. |
| 09wc | Drought stressed plants |
| 10wc | AMV infected leaf |
| 11wc | WCMV infected leaf |
| 12wc | Phosphorus starved plants |
| 13wc | Vegetative stolon tip |
| 14wc | stolon root initials |
| 15wc | Senescing stolon |
| 16wc | Senescing leaf |

TABLE 2 cDNA libraries from perennial ryegrass (*Lolium perenne*)

| Library | Organ/Tissue |
|---|---|
| 01rg | Roots from 3–4 day old light-grown seedlings |
| 02rg | Leaves from 3–4 day old light-grown seedlings |
| 03rg | Etiolated 3–4 day old dark-grown seedlings |
| 04rg | Whole etiolated seedlings (1–5 day old and 17 days old) |
| 05rg | Senescing leaves from mature plants |
| 06rg | Whole etiolated seedlings (1–5 day old and 17 days old) |
| 07rg | Roots from mature plants grown in hydroponic culture |
| 08rg | Senescent leaf tissue |
| 09rg | Whole tillers and sliced leaves (0, 1, 3, 6, 12 and 24 h after harvesting) |
| 10rg | Embryogenic suspension-cultured cells |
| 11rg | Non-embryogenic suspension-cultured cells |
| 12rg | Whole tillers and sliced leaves (0, 1, 3, 6, 12 and 24 h after harvesting) |
| 13rg | Shoot apices including vegetative apical meristems |
| 14rg | Immature inflorescences including different stages of inflorescence meristem and inflorescence development |
| 15rg | Defatted pollen |
| 16rg | Leaf blades and leaf sheaths (rbcL, rbcS, cab, wir2A subtracted) |
| 17rg | Senescing leaves and tillers |
| 18rg | Drought-stressed tillers (pseudostems from plants subjected to PEG-simulated drought stress) |
| 19rg | Non-embryogenic suspension-cultured cells subjected to osmotic stress (grown in media with half-strength salts) (1, 2, 3, 4, 5, 6, 24 and 48 h after transfer) |
| 20rg | Non-embryogenic suspension-cultured cells subjected to osmotic stress (grown in media with double-strength salts) (1, 2, 3, 4, 5, 6, 24 and 48 h after transfer) |
| 21rg | Drought-stressed tillers (pseudostems from plants subjected to PEG-simulated drought stress) |
| 22rg | Spikelets with open and maturing florets |
| 23rg | Mature roots (specific subtraction with leaf tissue) |

The cDNA libraries may be prepared by any of many methods available. For example, total RNA may be isolated using the Trizol method (Gibco-BRL, USA) or the RNeasy Plant Mini kit (Qiagen, Germany), following the manufacturers' instructions. cDNAs may be generated using the SMART PCR cDNA synthesis kit (Clontech, USA), cDNAs may be amplified by long distance polymerase chain reaction using the Advantage 2 PCR Enzyme system (Clontech, USA), cDNAs may be cleaned using the GeneClean spin column (Bio 101, USA), tailed and size fractionated, according to the protocol provided by Clontech. The cDNAs may be introduced into the pGEM-T Easy Vector system 1 (Promega, USA) according to the protocol provided by Promega. The cDNAs in the pGEM-T Easy plasmid vector are transfected into *Escherichia coli* Epicurian coli XL10-Gold ultra competent cells (Stratagene, USA) according to the protocol provided by Stratagene.

Alternatively, the cDNAs may be introduced into plasmid vectors for first preparing the cDNA libraries in Uni-ZAP XR vectors according to the manufacturer's protocol (Stratagene Cloning Systems, La Jolla, Calif., USA). The Uni-ZAP XR libraries are converted into plasmid libraries according to the protocol provided by Stratagene. Upon conversion, cDNA inserts will be contained in the plasmid vector pBluescript. In addition, the cDNAs may be introduced directly into precut pBluescript II SK(+) vectors (Stratagene) using T4 DNA ligase (New England Biolabs), followed by transfection into *E. coli* DH10B cells according to the manufacturer's protocol (GIBCO BRL Products).

Once the cDNA inserts are in plasmid vectors, plasmid DNAs are prepared from randomly picked bacterial colonies containing recombinant plasmids, or the insert cDNA sequences are amplified via polymerase chain reaction using primers specific for vector sequences flanking the inserted cDNA sequences. Plasmid DNA preparation may be performed robotically using the Qiagen QiaPrep Turbo kit (Qiagen, Germany) according to the protocol provided by Qiagen. Amplified insert DNAs are sequenced in dye-terminator sequencing reactions to generate partial cDNA sequences (expressed sequence tags or "ESTs"). The resulting ESTs are analysed using an Applied Biosystems ABI 3700 sequence analyser.

EXAMPLE 2

DNA Sequence Analyses

The cDNA clones encoding CS, CS-like, MDH, MDH-like, PEPC and PEPC-like polypeptides were identified by conducting BLAST (Basic Local Alignment Search Tool; Altschul et al. (1993) *J. Mol. Biol.* 215:403-410) searches. The cDNA sequences obtained were analysed for similarity to all publicly available DNA sequences contained in the eBioinformatics nucleotide database using the BLASTN algorithm provided by the National Center for Biotechnology Information (NCBI). The DNA sequences were translated in all reading frames and compared for similarity to all publicly available protein sequences contained in the SWISS-PROT protein sequence database using BLASTx algorithm (v 2.0.1) (Gish and States (1993) *Nature Genetics* 3:266-272) provided by the NCBI.

The cDNA sequences obtained and identified were then used to identify additional identical and/or overlapping cDNA sequences generated using the BLASTN algorithm. The identical and/or overlapping sequences were subjected to a multiple alignment using the CLUSTALw algorithm, and to generate a consensus contig sequence derived from this multiple sequence alignment. The consensus contig sequence was then used as a query for a search against the SWISS-PROT protein sequence database using the BLASTx algorithm to confirm the initial identification.

EXAMPLE 3

Identification and Full-Length Sequencing of cDNAs Encoding CS, MDH and PEPC Polypeptides To fully characterise for the purposes of the generation of probes for hybridisation experiments and the generation of transformation vectors, a set of cDNAs encoding white clover CS, MDH and PEPC polypeptides was identified and fully sequenced.

Full-length cDNAs were identified from our EST sequence database using relevant published sequences (NCBI databank) as queries for BLAST searches. Full-length cDNAs were identified by alignment of the query and hit sequences using Sequencher (Gene Codes Corp., Ann Arbor, Mich. 48108, USA). The original plasmid was then used to transform chemically competent XL-1 cells (prepared in-house, $CaCl_2$ protocol). After colony PCR (using HotStarTaq, Qiagen) a minimum of three PCR-positive colonies per transformation were picked for initial sequencing with M13F and M13R primers. The resulting sequences were aligned with the original EST sequence using Sequencher to confirm identity and one of the three clones was picked for full-length sequencing, usually the one with the best initial sequencing result.

Sequencing of all cDNAs was completed by primer walking, i.e. oligonucleotide primers were designed to the initial sequence obtained using M13F and M13R oligonucleotide primers and used for further sequencing. The sequences of the oligonucleotide primers are shown in Table 2.

Contigs were then assembled in Sequencher. The contigs include the sequences of the SMART primers used to generate the initial cDNA library as well as pGEM-T Easy vector sequence up to the EcoRI cut site both at the 5' and 3' end.

Figure 6:
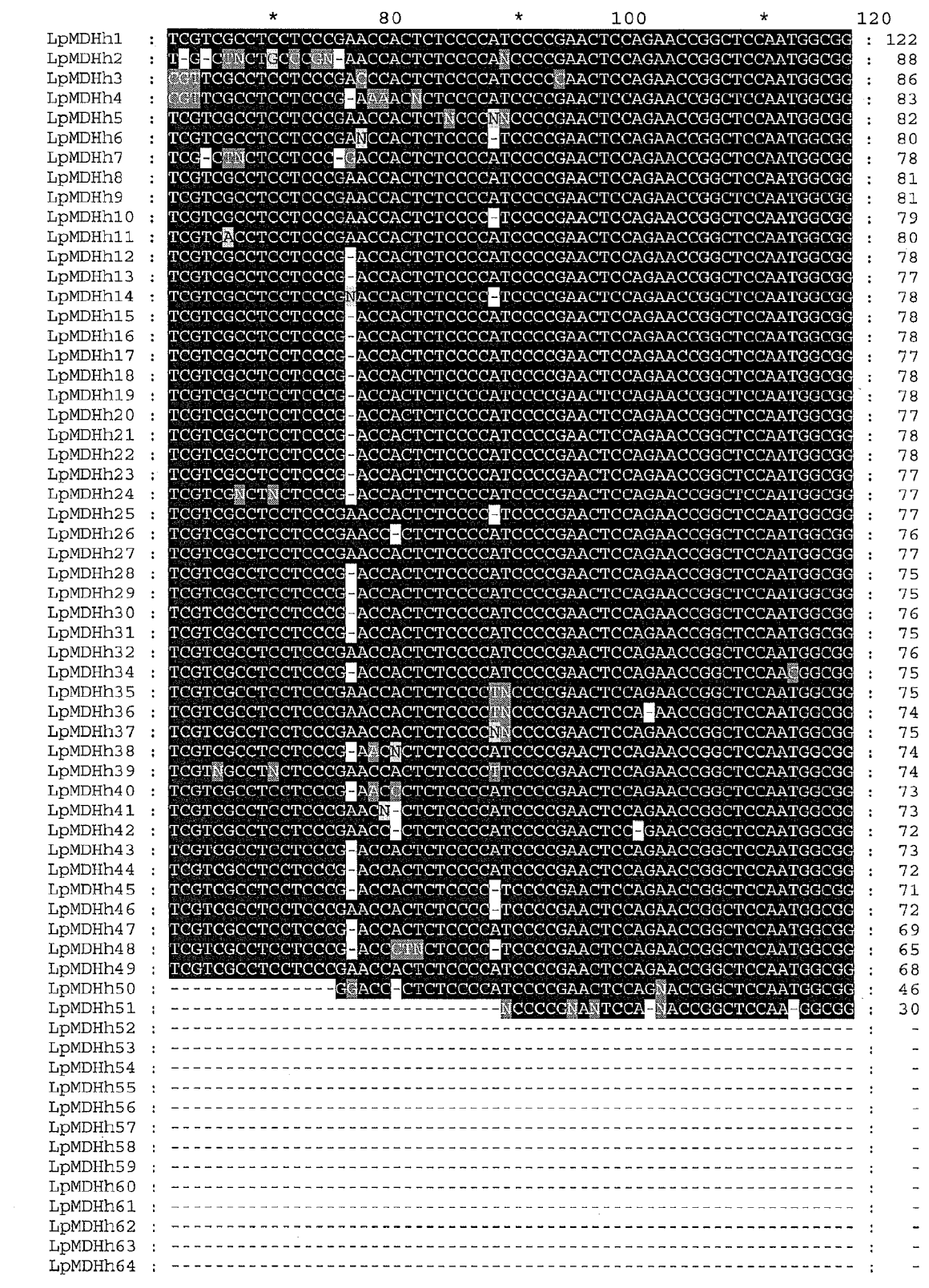

Plasmid maps and the full cDNA sequences of TrCSa, TrCSb, TrCSd, TrMDH and TrPEPC polypeptides were obtained (SEQ ID NOS: 1, 2, 12, FIG. 2, SEQ ID NOS: 19, 20, FIG. 3, SEQ ID NOS: 30, 34, 35, 38, 39, FIG. 5, SEQ ID NOS: 44, 47 and FIG. 6).

TABLE 3

List of primers used for sequencing of the full-length cDNAs encoding CS, MDH and PEPC

| gene name | clone ID | sequencing primer | Seq. ID NO: | primer sequence (5'>3') |
|---|---|---|---|---|
| TrCSa | 05wc1HsB08 | 05wc1HsB08.f1 | 355 | TTGCCCGAGGCTATACTGTGGC |
| | | 05wc1HsB08.f2 | 356 | CAGCTCACCTAGTTGCTAG |
| | | 05wc1HsB08.f3 | 357 | CCATGGCCTAATGTTGATGC |
| | | 05wc1HsB08.r1 | 358 | TTGGCCTTTCAAGTGGCATTCC |
| | | 05wc1HsB08.r2 | 359 | CAGAATGGGAGGCACGACTTC |
| | | 05wc1HsB08.r3 | 360 | ATGTGAGCATAGTTTGCACC |
| TrCSb | 05wc2HsD09 | 05wc2HsD09.f1 | 361 | GACTGCCAGAAAACACTTCCAGG |
| | | 05wc2HsD09.f2 | 362 | ATGACTGCTTTAGTGTGG |
| | | 05wc2HsD09.r1 | 363 | CTCAAGTTTCTCCAGTGTGACAC |
| | | 05wc2HsD09.r2 | 364 | TGACTTATGTATCCCACC |
| | | 05wc2HsD09.r3 | 365 | GCTCTGAATGGTTTAGCTGG |
| TrCSd | 10wc1BsF10 | 10wc1BsF10.f1 | 366 | GCACTGCCTGTTTCTGCTCATCC |
| | | 10wc1BsF10.f2 | 367 | AGCCAACTTATGAGGATAGC |
| | | 10wc1BsF10.r1 | 368 | CTCCAATACTCCTCGCGACGCC |
| | | 10wc1BsF10.r2 | 369 | AGGCACAACCTGGCCACTG |
| | | 10wc1BsF10.r3 | 370 | ACGTTGCCACCTTCATGATC |
| TrMDH | 13wc1NsD01 | 13wc1NsD01.f1 | 371 | GTTGTTATACCTGCTGGTGTT |
| | | 13wc1NsD01.r1 | 372 | CTCACTCAACCCTTGGAGAT |
| TrPEPC | 15wc1DsH12 | 15wc1DsH12.f1 | 373 | TCCTAAGAAACTTGAAGAGCTCGG |
| | | 15wc1DsH12.f2 | 374 | AGATGTTTGCTTACTAGC |
| | | 15wc1DsH12.r1 | 375 | GCCAGCAGCAATACCCTTCATGG |
| | | 15wc1DsH12.r2 | 376 | TTGCTTCTCAACTGTTCC |

EXAMPLE 4

Development of Binary Transformation Vectors Containing Chimeric Genes with cDNA Sequences Encoding CS, MDH and PEPC To alter the expression of the polypeptides involved in organic acid biosynthesis to improve phosphorus acquisition efficiency as well as aluminium and acid soil tolerance in forage plants, a set of sense binary transformation vectors was produced.

The pPZP221 binary transformation vector (Hajdukiewicz et al., 1994) was modified to contain the $35S^2$ cassette from pKYLX71:$35S^2$ (Schardl et al., 1987) as follows: pKYLX71:$35S^2$ was cut with ClaI. The 5' overhang was filled in using Klenow and the blunt end was A-tailed with Taq polymerase. After cutting with EcoRI, the 2 kb fragment with an EcoRI-compatible and a 3'-A tail was gel-purified. pPZP221 was cut with HindIII and the resulting 5' overhang filled in and T-tailed with Taq polymerase. The remainder of the original pPZP221 multi-cloning site was removed by digestion with EcoRI, and the expression cassette cloned into the EcoRI site and the 3' T overhang restoring the HindIII site. This binary vector contains between the left and right border the plant selectable marker gene aacC1 under the control of the 35S promoter and 35S terminator and the pKYLX71:$35S^2$-derived expression cassette with a CaMV 35S promoter with a duplicated enhancer region and an rbcS terminator.

A GATEWAY® cloning cassette (Invitrogen) was introduced into the multicloning site of the pPZP221:$35S^2$ vector obtained as described following the manufacturer's protocol.

cDNA fragments were generated by high fidelity PCR with a proofreading DNA polymerase using the original pGEM-T Easy plasmid cDNA as a template. The primers used (Table 3) contained attB sequences for use with recombinases utilising the GATEWAY® system (Invitrogen). The resulting PCR fragments were used in a recombination reaction with pDONR® vector (Invitrogen) to generate entry vectors. In a further recombination reaction, the cDNAs encoding the open reading frame sequences were transferred from the entry vector to the GATEWAY®-enabled pPZP221:$35S^2$ vector.

The orientation of the constructs (sense or antisense) was checked by restriction enzyme digest and sequencing which also confirmed the correctness of the sequence. Transformation vectors containing chimeric genes using full-length open reading frame cDNAs encoding white clover TrCSa, TrCSb, TrCSd, TrMDH and TrPEPC proteins in sense orientation under the control of the CaMV $35S^2$ promoter were generated (SEQ ID NOS: 11, 18, 22, FIG. 4, SEQ ID NOS: 37, 41 and 46).

TABLE 4

List of primers used to PCR-amplify the open reading frames of cDNAs encoding CS, MDH and PEPC

| gene name | clone ID | primer | Seq ID No | primer sequence (5'>3') |
|---|---|---|---|---|
| TrCSa | 05wc1HsB08 | 05wc1HsB08f | 377 | GGGGACAAGTTTGTACAAAAAAG CAGGCTTGATCTTAATGGCGTTCT TTCG |
| | | 05wc1HsB08r | 378 | GGGGACCACTTTGTACAAGAAAGC TGGGTTTTCAATTTTAGGACGATG CG |
| TrCSb | 05wc2HsD09 | 05wc2HsD09f | 379 | GGGGACAAGTTTGTACAAAAAAG CAGGCTTTGTTGATTGATCTTAAT GGC |
| | | 05wc2HsD09r | 380 | GGGGACCACTTTGTACAAGAAAGC TGGGTTAGTAATCCACAGATAACC G |
| TrCSd | 10wc1BsF10 | 10wc1BsF10f | 381 | GGGGACAAGTTTGTACAAAAAAG CAGGCTCTAGATTGTTGATTGATC TAAATGGC |
| | | 10wC1BsF10r | 382 | GGGGACCACTTTGTACAAGAAAGC TGGGTCTAGATTCAATTTTAGGAT GATGCACC |
| TrMDH | 13wc1NsD1 | 13wc1NsD01f | 383 | GGGGACAAGTTTGTACAAAAAAG CAGGCTCTAGAAATTCCCATTACC ATTCATTCC |
| | | 13wc1NsD01r | 384 | GGGGACCACTTTGTACAAGAAAGC TGGGTCTAGATTGACATTCTCTCG CATGGACGC |
| TrPEPC | 15wc1DsH2 | 15wc1DsH12f | 385 | GGGGACAAGTTTGTACAAAAAAG CAGGCTTGAGAAGGAGTGAATTGC TCC |
| | | 15wc1DsH12r | 386 | GGGGACCACTTTGTACAAGAAAGC TGGGTATGATATCTTAGCACACAC TTAAC |

EXAMPLE 5

Development of Binary Transformation Vectors Containing Chimeric Genes with a Combination of 2 or More cDNA Sequences Encoding CS, MDH and PEPC To alter the expression of the polypeptides involved in organic acid biosynthesis to improve phosphorus acquisition efficiency as well as aluminium and acid soil tolerance in forage plants, a modular binary transformation vector system was used (FIG. 33). The modular binary vector system enables simultaneous integration of up to seven transgenes the expression of which is controlled by individual promoter and terminator sequences into the plant genome (Goderis et al., 2002).

The modular binary vector system consists of a pPZP200-derived vector (Hajdukiewicz et al., 1994) backbone containing within the T-DNA a number of simultaneous integration of up to seven transgenes the expression of which is controlled by individual promoter and terminator sequences into the plant genome. (Goderis et al., 2002).

The modular binary vector system consists of a pPZP200-derived vector (Hajdukiewicz et al., 1994) backbone containing within the T-DNA a number of unique restriction sites recognised by homing endonucleases. The same restriction sites are present in pUC18-based auxiliary vectors flanking standard multicloning sites. Expression cassettes comprising a selectable marker gene sequence or a cDNA sequence to be introduced into the plant under the control of regulatory sequences like promoter and terminator can be constructed in the auxiliary vectors and then transferred to the binary vector backbone utilising the homing endonuclease restriction sites. Up to seven expression cassettes can thus be integrated into a single binary transformation vector. The system is highly flexible and allows for any combination of cDNA sequence to be introduced into the plant with any regulatory sequence.

For example, a selectable marker cassette comprising the nos promoter and nos terminator regulatory sequences controlling the expression of the nptII gene was PCR-amplified using a proofreading DNA polymerase from the binary vector pKYLX71:35S$^2$ and directionally cloned into the AgeI and NotI sites of the auxiliary vector pAUX3166. Equally, other selectable marker cassettes can be introduced into any of the auxiliary vectors.

In another example, the expression cassette from the binary vector pWM5 consisting of the ASSU promoter and the tob terminator was PCR-amplified with a proofreading DNA polymerase and directionally cloned into the AgeI and NotI sites of the auxiliary vector pAUX3169. Equally, other expression cassettes can be introduced into any of the auxiliary vectors.

In yet another example, the expression cassette from the direct gene transfer vector pDH51 was cut using EcoRI and cloned directly into the EcoRI site of the auxiliary vector pAUX3132.

TABLE 5

List of primers used to PCR-amplify plant selectable marker cassettes and the regulatory elements used to control the expression of CS, MDH and PEPC genes

| expression cassette | primer | Seq. ID No. | primer sequence (5'>3') |
|---|---|---|---|
| nos::nptII-nos | forward | 387 | ATAATAACCGGTTGATCATGAGCGGAGAATTAAGGG |
| | reverse | 388 | ATAATAGCGGCCGCTAGTAACATAGATGACACCGCG |
| 35S::aacC1-35S | forward | 389 | AATAGCGGCCGCGATTTAGTACTGGATTTTGG |
| | reverse | 390 | AATAACCGGTACCCACGAAGGAGCATCGTGG |
| 35S$^2$::rbcS | forward | 391 | ATAATAACCGGTGCCCGGGGATCTCCTTTGCC |
| | reverse | 392 | ATAATAGCGGCCGCATGCATGTTGTCAATCAATTGG |
| assu::tob | forward | 393 | TAATACCGGTAAATTTATTATGRGTTTTTTTCCG |
| | reverse | 394 | TAATGCGGCCGCTAAGGGCAGCCCATACAAATGAAGC |

The expression cassettes were further modified by introducing a GATEWAY® cloning cassette (Invitrogen) into the multicloning site of the respective pAUX vector following the manufacturer's protocol. In a recombination reaction, the cDNAs encoding the open reading frame sequences were transferred from the entry vector obtained as described in Example 4 to the GATEWAY®-enabled pAUX vector. Any combination of the regulatory elements with cDNA sequences of TrCSa, TrCSb, TrCSd, TrMDH and TrPEPC can be obtained. One typical example is given in FIG. 34 with expression cassettes comprising the nptII plant selectable marker, TrPEPC, TrCSa and TrMDH.

Complete expression cassettes comprising any combination of regulatory elements and cDNA sequences to be introduced into the plant were then cut from the auxiliary vectors using the respective homing endonuclease and cloned into the respective restriction site on the binary vector backbone. After verification of the construct by nucleotide sequencing, the binary transformation vector comprising a number of expression cassettes was used to generate transgenic white clover plants.

EXAMPLE 6

Isolation of Regulatory Elements to Direct Expression of Chimeric Genes Encoding CS, MDH and PEPC Involved in Organic Acid Biosynthesis To direct the expression of chimeric white clover genes TrCSa, TrCSb, TrCSd, TrMDH and TrPEPC involved in organic acid biosynthesis to specific tissues, regulatory elements showing specificity for expression in root or root tip tissue were identified and isolated.

Using the BLASTn algorithm, white clover EST sequence collections prepared as detailed in Examples 1 and 2 were searched with nucleotide sequences representing genes with known root-specific expression identified in GenBank as queries. Suitable candidate ESTs were identified and oligonucleotide primers for reverse transcription-PCR (RT-PCR) were designed (see Table 4).

TABLE 6

Oligonucleotide primers used in reverse transcription-PCR to confirm tissue specificity of candidate white clover ESTs

| gene | forward primer (5'->3') | reverse primer (5'->3') |
|---|---|---|
| histone (internal control) | CCGATTCCGTTTCAATG GCTCGTA SEQ ID No: 395 | GCCATCCTTAACCCTAAG CACGT SEQ ID No: 396 |
| white clover phosphate transporter homolog | TTGCATTTGCTTGGAAC AACTAG SEQ ID No: 397 | GCAAGAGCAAACATGAA ACCA SEQ ID No: 398 |
| white clover root iron transporter homolog | ATGGGTCTTGGTGGTTG CA SEQ ID No: 398 | GCAGCAAGAAGATCAAC CAAAGCCA SEQ ID No: 400 |

Total RNA for RT-PCR experiments was isolated from a leaf, stolon, stolon tip, root and root tip of white clover plants grown in the glasshouse using the TRIZOL method. Reverse transcription was performed using SuperScriptII (Invitrogen) following the supplier's instructions. Preliminary PCR reactions using Dynazyme as the DNA polymerase were set up to determine the correct amount of template using the PCR primers for the internal control (histone). The results of this preliminary PCR were used to set up another round of PCR to determine the optimum number of cycles for linear amplification. The final PCR amplifications were performed using the following cycling conditions: 94° C., 4 min., 1 time; 94° C., 15 sec., 60° C., 30 sec., 72° C., 2 min., xtimes; 72° C., 10 min., 1 time. The number of cycles in the amplification (x) was found to be dependent on the relative abundance of transcript and had to be optimised for each template.

RT-PCR results using a white clover histone gene as an internal constitutively expressed control confirmed the tissue-specificity of two candidate ESTs to be root-prevalent (FIGS. 35 A and B). These were a phosphate transporter homolog (clone name 02wc1DsG07) and a root iron transporter homolog (clone name 05wc1IsB 11).

A spotted white clover BAC library consisting of 50,304 clones with an estimated 99% genome coverage (6.3 genome equivalents) was screened using the phosphate transporter homolog EST nucleotide sequence as a probe. A number of positive BAC clones could be identified (FIG. 36 A). After Southern hybridisation blotting (FIG. 36 B) a 7.5 kb EcoRV genomic DNA fragment was selected and fully sequenced. The fragment contained the phosphate transporter homolog open reading frame and 4 kb of upstream sequence including the promoter region. A physical map of the genomic DNA fragment including the promoter region is shown in FIG. 36 C.

EXAMPLE 7

Production by *Agrobacterium*-Mediated Transformation and Analysis of Transgenic White Clover Plants Carrying Chimeric Genes Encoding CS, MDH and PEPC Involved in Organic Acid Biosynthesis A set of binary transformation vectors carrying chimeric white clover genes to alter the expression of the polypeptides involved in organic acid biosynthesis to improve phosphorus acquisition efficiency as well as aluminium and acid soil tolerance in forage plants were produced as detailed in Examples 4 and 5.

*Agrobacterium*-mediated gene transfer experiments were performed using these transformation vectors.

The production of transgenic white clover plants carrying the white clover TrCSa, TrCSb, TrCSd, TrMDH and TrPEPC cDNAs, either singly or in combination, is described here in detail (Table 7).

Preparation of *Agrobacterium*

*Agrobacterium tumefaciens* strain AGL-1 transformed with one of the binary vector constructs detailed in Example 6 were streaked on LB medium containing 50 μg/ml rifampicin and 50 μg/ml kanamycin and grown at 27° C. for 48 hours. A single colony was used to inoculate 5 ml of LB medium containing 50 μg/ml rifampicin and 50 μg/ml kanamycin and grown over night at 27° C. and 250 rpm on an orbital shaker. The overnight culture was used as an inoculum for 500 ml of LB medium containing 50 μg/ml kanamycin only. Incubation was over night at 27° C. and 250 rpm on an orbital shaker in a 2 l Erlenmeyer flask.

Preparation of White Clover Seeds 1 spoon of seeds (ca. 500) was placed into a 280 μm mesh size sieve and washed for 5 min under running tap water, taking care not to wash seeds out of sieve. In a laminar flow hood, seeds were transferred with the spoon into an autoclaved 100 ml plastic culture vessel. A magnetic stirrer (wiped with 70% EtOH) and ca. 30 ml 70% EtOH were added, and the seeds were stirred for 5 min. The EtOH was discarded and replaced by 50 ml 1.5% sodium hypochlorite. The seeds were stirred for an additional 45-60 min on a magnetic stirrer. The sodium hypochlorite was then discarded and the seeds rinsed 3 to 4 times with autoclaved ddH$_2$O. Finally 30 ml of ddH$_2$O were added, and seeds incubated over night at 10-15° C. in an incubator.

*Agrobacterium*-Mediated Transformation of White Clover

The seed coat and endosperm layer of the white clover seeds prepared as above were removed with a pair of 18 G or 21 G needles. The cotyledons were cut from the hypocotyl leaving a ca. 1.5 mm piece of the cotyledon stalk. The cotyledons were transferred to a petridish containing ddH$_2$O. After finishing the isolation of clover cotyledons, ddH$_2$O in the petridish was replaced with *Agrobacterium* suspension (diluted to an OD$_{600}$=0.2-0.4). The petridish was sealed with its lid and incubated for 40 min at room temperature.

After the incubation period, each cotyledon was transferred to paper towel using the small dissection needle, dried and plated onto regeneration medium RM73. The plates were incubated at 25° C. with a 16 h light/8 h dark photoperiod. On day 4, the explants were transferred to fresh regeneration medium. Cotyledons transformed with *Agrobacterium* were transferred to RM73 containing cefotaxime (antibacterial agent) and gentamycin. The dishes were sealed with Parafilm and incubated at 25° C. under a 16/8 h photoperiod. Explants were subcultured every three weeks for a total of nine weeks onto fresh RM 73 containing cefotaxime and gentamycin.

Genomic DNA for Southern hybridisation blotting was obtained from leaf material of white clover plants following the CTAB method. Southern hybridisation blotting experiments were performed following standard protocols as described in Sambrook et al. (1989). In brief, genomic DNA samples were digested with appropriate restriction enzymes and the resulting fragments separated on an agarose gel. After transfer to a membrane, a cDNA fragment representing a transgene or selectable marker gene was used to probe the size-fractionated DNA fragments. Hybridisation was performed with either radioactively labelled probes or using the non-radioactive DIG labelling and hybridisation protocol (Boehringer) following the manufacturer's instructions.

Plants were obtained after transformation with all chimeric constructs and selection on medium containing gentamycin. Details of plant analysis are given in Table 5 and FIGS. 38, 39 and 40.

TABLE 7

Transformation of white clover with binary transformation vectors comprising cDNAs encoding CS, MDH and PEPC involved in organic acid biosyntheses, selection and molecular analysis of regenerated plants.

| construct | cotyledons transformed | selection into RIM | soil | QPCR-positive | Southern | copy number range |
|---|---|---|---|---|---|---|
| pPZP221-35S2::TrMDH | 2739 | 72 | 45 | 43 | n/d | |
| pPZP221-35S2::TrCS | 2550 | 39 | 7 | nd | n/d | |
| pPZP221-35S2::TrPEPC | 2730 | 44 | 10 | nd | n/d | |

Shoots with a green base were then transferred to root-inducing medium RIM. Roots developed after 1-3 weeks, and plantlets were transferred to soil when the roots were well established.

Preparation of Genomic DNA for Real-Time PCR and Analysis for the Presence of Transgenes 3-4 leaves of white clover plants regenerated on selective medium were harvested and freeze-dried. The tissue was homogenised on a Retsch MM300 mixer mill, then centrifuged for 10 min at 1700×g to collect cell debris. Genomic DNA was isolated from the supernatant using Wizard Magnetic 96 DNA Plant System kits (Promega) on a Biomek FX (Beckman Coulter). 5 µl of the sample (50 µl) were then analysed on an agarose gel to check the yield and the quality of the genomic DNA.

Genomic DNA was analysed for the presence of the transgene by real-time PCR using SYBR Green chemistry. PCR primer pairs were designed using MacVector (Accelrys) or PrimerExpress (ABI). The forward primer was located within the 35S$^2$ promoter region and the reverse primer within the transgene to amplify products of approximately 150-250 bp as recommended. The positioning of the forward primer within the 35S$^2$ promoter region guaranteed that endogenous genes in white clover were not detected.

5 µl of each genomic DNA sample was run in a 50 µl PCR reaction including SYBR Green on an ABI 7700 (Applied Biosystems) together with samples containing DNA isolated from wild type white clover plants (negative control), samples containing buffer instead of DNA (buffer control) and samples containing the plasmid used for transformation (positive plasmid control). Cycling conditions used were 2 min. at 50° C., 10 min. at 95° C., and then 40 cycles of 15 sec. at 95° C., 1 min. at 60° C.

Preparation of Genomic DNA and Analysis of DNA for Presence and Copy Number of Transgene by Southern Hybridisation Blotting

REFERENCES

Altschul, S. F., Gish, W., Miller, W., Myers, E. W., Lipman, D. J. (1990) "Basic local alignment search tool." J. Mol. Biol. 215, 403-410.

Frohman, M. A., Dush, M. K., Martin, G. R. (1988) Rapid production of full-length cDNAs from rare transcripts: amplification using a single gene-specific oligonucleotide primer. Proc. Natl. Acad. Sci. USA 85, 8998.

Gish, W., States, D. J. (1993) Identification of protein coding regions by database similarity search. Nature Genetics 3, 266-272.

Goderis, I., De Bolle, M. F. C., Francois, I., Wouters, P. F. J., Broekaert, W. F., and Cammue, B. P. A. (2002) A set of modular plant transformation vectors allowing flexible insertion of up to six expression units. Plant Molecular Biology 50, 17-27.

Hajdukiewicz P, Svab Z, Maliga P. (1994) The small, versatile pPZP family of Agrobacterium binary vectors for plant transformation. Plant Mol Biol. 25, 989-94.

Loh, E. Y., Elliott, J. F., Cwirla, S., Lanier, L. L., Davis, M. M. (1989). Polymerase chain reaction with single-sided specificity: Analysis of T-cell receptor delta chain. Science 243, 217-220.

Ohara, O., Dorit, R. L., Gilbert, W. (1989). One-sided polymerase chain reaction: The amplification of cDNA. Proc. Natl. Acad Sci USA 86, 5673-5677

Sambrook, J., Fritsch, E. F., Maniatis, T. (1989). Molecular Cloning. A Laboratory Manual. Cold Spring Harbour Laboratory Press Schardl, C. L., Byrd, A. D., Benzion, G., Altschuler, M. A., Hildebrand, D. F., Hunt, A. G. (1987) Design and construction of a versatile system for the expression of foreign genes in plants. Gene 61, 1-11

Finally, it is to be understood that various alterations, modifications and/or additions may be made without departing from the spirit of the present invention as outlined herein.

SEQUENCE LISTING (400 sequences)

SEQ ID NO: 1 - DNA, 1550 bp, Lolium perenne
  misc_feature (2)..(3): n is a, c, g, or t
gnnttatattgacggggatgagggaattcttcgctacagaggctatccaattgaggaggtggctgaaagcagctcgtttgttgaggtcgcctacctcttaatgtatgggaatttgcccacccagagtcaactggcaggctgggagtttgcaatttcgcagcactctgctgttcctcaaggactcttggatataatacaatcaatgcctcatgatgcccaccccatgggtgtccttgccagtgcaatgagcacactttcagtcttccatccagatgcaaaccctgctcttagaggtcaagatctatacaagtcgaagcaggttagggataagcaaattgtacgagttcttgggaaggcaccagtaatagcagctgcagcctatctgagattagcaggaaggccctttgtccttccttcaaataatctctcttattcagaaaatttcttgtatatgctggactctatgggtgacaaagattataagccaaatcccagacttgcccgggttctggatgtcctttttattcttcatgctgaacacgaaatgaactgctcaacagctgctgttaggcaccttgcttcaagtggtgtcgatgtcttcactgctctttctggtgctgttggagctctatatggtccactgcatggtggcgcaaatgaggcggtacttaaaatgttaaatgagattggaagtgtagagaatattccggaattcattgagggagtgaagaacaggaagcggaaaatgtctggttttgggcaccgtgtgtataagaattatgatcctcgtgctaaagtcatccggaagttagcggaggaggttttcacgattgtgggacgggatcctcttatcgaggtagctgttgctttggagaaggcagcactgtcagacgagtattttatcaagaggaagctgtatccaaatgtggatttttattctggcctaatatatagggcaatgggattccctacagagtttttccctgttctgtttgcagttcctcgcatggctggttggttagcacattggaaggagtcacttgatgaccccgacaataaaattatgaggccccaacaggtatacaccggtacttggctaaggcattacaccccagtgagagaacgggtgccatcaagcgacagtgagcagcttgggcagatcgctacatcaaacgcgacgaggcgtcggcgtgctggctctgccctgtagaacagtctgcatgatacagcatacagtccacacaataaaccaagctgccaagggccacggctgcttaaatctgggagctgctatacttgtgttatcacgtatatataggcaataaactaataatgccgccaggacacttcactggtggtcatgtgaagttggtagtagaatgcacttgtaacgtgttgttaatttgttatcctgcaatgtacgctctataaactgttcagtatcttgaaagtcttaatcatgtggaccaatgaagacatagatcaagttctttgcatgggcggcggctgtttctttgggaaaaaactttttatgggagtctttttttacc

SEQ ID NO: 2 - protein, 401 aa, Lolium perenne
YIDGDEGILRYRGYPIEEVAESSSFVEVAYLLMYGNLPTQSQLAGWEFAISQHSAVPQGLLDIIQSMPHDAHPMGVLASAMSTLSVFHPDANPALRGQDLYKSKQVRDKQIVRVLGKAPVIAAAAYLRLAGRPFVLPSNNLSYSENFLYMLDSMGDKDYKPNPRLARVLDVLFILHAEHEMNCSTAAVRHLASSGVDVFTALSGAVGALYGPLHGGANEAVLKMLNEIGSVENIPEFIEGVKNRKRKMSGFGHRVYKNYDPRAKVIRKLAEEVFTIVGRDPLIEVAVALEKAALSDEYFIKRKLYPNVDFYSGLIYRAMGFPTEFFPVLFAVPRMAGWLAHWKESLDDPDNKIMRPQQVYTGTWLRHYTPVRERVPSSDSEQLGQIATSNATRRRRAGSAL

SEQ ID NO: 3 - DNA, 763 bp, Lolium perenne
  misc_feature (2)..(3): n is a, c, g, or t
  misc_feature (649)..(649): n is a, c, g, or t
  misc_feature (661)..(661): n is a, c, g, or t
  misc_feature (753)..(753): n is a, c, g, or t
  misc_feature (763)..(763): n is a, c, g, or t
gnnttatattgacggggatgagggaattcttcgctacagaggctatccaattgaggaggtggctgaaagcagctcgtttgttgaggtcgcctacctcttaatgtatgggaatttgcccacccagagtcaactggcaggctgggagtttgcaatttcgcagcactctgctgttcctcaaggactcttggatataatacaatcaatgcctcatgatgcccaccccatgggtgtccttgccagtgcaatgagcacactttcagtcttccatccagatgcaaaccctgctcttagaggtcaagatctatacaagtcgaagcaggttagggataagcaaattgtacgagttcttgggaaggcaccagtaatagcagctgcagcctatctgagattagcaggaaggccttttgtccttccttcaaataatctctcttattcagaaaatttcttgtatatgctggactctatgggtgacaaagattataagccaaatcccagacttgcccgggttctggatgtcctttttattcttcatgctgaacacgaaatgaactgctcaacagctgctgttaggcaccttgcttcaagtggtgtcgatgtcttcactgctctttctggtgctgttggagctctatatggtccactgcatggnggcgcaaatgangcggtacttaaatgttaaatgagattggaagtgtagagaatattccggaattcattgagggagtgaagaacaggaagcggaaaatgtctggntttgggcacn

SEQ ID NO: 4 - DNA, 682 bp, Lolium perenne
  misc_feature (44)..(44): n is a, c, g, or t
  misc_feature (46)..(46): n is a, c, g, or t
  misc_feature (682)..(682): n is a, c, g, or t
gcaggctgggagtttgcaatttcgcacactctgctgttcctcangnactcttggatataatacaatcaatgcctcatgatgcccaccccatgggtgtccttgccagtgcaatgagcacactttcagtcttccatccagatgcaaaccctgctcttagaggtcaagatctatacaagtcgaagcaggttagggataagcaaattgtacgagttcttgggaaggcaccagtaatagcagctgcagcctatctgagattagcaggaaggccctttgtccttccttcaaataatctctcttattcagaaaatttcttgtatatgctggactctatgggtgacaaagattataagccaaatcccagacttgcccgggttctggatgtcctttttattcttcatgctgaacacgaaatgaactgctcaacagctgctgttaggcaccttgcttcaagtggtgtcgatgtcttcactgctctttctggtgctgttggagctctatatggtccactgcatggtggcgcaaatgaggcggtacttaaaatgttaaatgagattggaagtgtagagaatattccggaattcattgagggagtgaagaacaggaagcggaaaatgtctggttttgggcaccgtgtgtataagaattatgatcctcgtgctaaagtcatccggaagttagcggn

SEQ ID NO: 5 - DNA, 753 bp, Lolium perenne
  misc_feature (1)..(1): n is a, c, g, or t
  misc_feature (4)..(4): n is a, c, g, or t
  misc_feature (21)..(21): n is a, c, g, or t
  misc_feature (753)..(753): n is a, c, g, or t
nttntgctgacacgaaatganctgctcaacagctgctgttaggcaccttgcttcaagtggtgtcgatgtcttcactgctctttctggtgctgttggagctctatatggtccactgcatggtggcgcaaatgaggcggtacttaaaatgttaaatgagattggaagtgtagagaatattccggaattcattgagggagtgaagaacaggaagcggaaaatgtctggctttgggcaccgtgtgtataagaattatgatcctcgtgctaaagtcatccggaagttagcggaggaggttttcacgattgtgggacgggatcctcttatcgaggtagctgttgctttggagaaggtagcactgtcagacgagtattttatcaagaggaagctgtatccaaatgtggatttttattctggcctaatatatagggcaatgggattccctacagagtttttccctgttctgtttgcagttcctcgcatggctggttggttagcacattggaaggagtcacttgatgaccccgacaataaaattatgaggccccaacaggtatacaccggtacttggctaaggcattacaccccagtgagagaacgggtgccatcaagcgacagtgagcagcttgggcagatcactacatcaaacgcgacgaggcgtcggcgtgctggttctgccctgtagaacagtctgcatgatacagcatacagtccacacaataaaccaagctgccaagggccacggctgcttaaatn

SEQ ID NO: 6 - DNA, 745 bp, Lolium perenne
  misc_feature (739)..(739): n is a, c, g, or t
gattatcctcgcgctaaagtcatccggagttagcggaggaggttttcacgattgtgggacgggatcctcttatcgaggtagctgttgctttggagaaggcagcactgtcagacgagtattttatcaagaggaagctgtatccaaatgtggatttttattctggcctaatatatagggcaatgggattccctgcagagtttttccctgttctgtttgcagttcctcgcatggctggttggttagcacattggaaggagtcacttgatgaccccgacaataaaattatgaggccccaacaggtatacaccggtacttggctaaggcattacaccccagtgagagaacgggtgccatcaagcgacagtgagcagcttgggcagatcgctacatcaaacgcgacgaggcgtcggcgtgctggctctgccctgtagaacagtctgcatgatacagcatacagtccacacaataaaccaagctgccaagggccacggctgcttaaatctgggagctgctatacttgtgttatcacgtatatgtaggcaataaactaataatgccgccaggacacttcactggtggtcatgtgaagttggtagtagaatgcacttgtaacgtgttgttaatttgttatcctgcaatgtacgctctataaactgttcagtgtcttgaaagtcttaatcatgtggaccaagaagacatagatcaagttctttgcatgggcggcggctgtttctttggnaaaaaa

SEQ ID NO: 7 - DNA, 666 bp, Lolium perenne
  misc_feature (40)..(40): n is a, c, g, or t
  misc_feature (654)..(654): n is a, c, g, or t
  misc_feature (658)..(661): n is a, c, g, or t
ggaagttagcggaggaggttttcacgattgtgggacgggntcctcttatcgaggtagctgttgctttggagaaggcagcactgtcagacgagtattttatcgagaggaagctgtatccaaatgtggatttttattctggcctaatatatagggcaatgggattccctacagagtttttccctgttctgtttgcagttcctcgcatggctggttggttagcacattggaaggagtcacttgatgaccccgacaataaaattatgaggccccaacaggtatacaccggtacttggctaaggcattacaccccagtgagagaacgggtgccatcaagcgacagtgagcagcttgggcagatcgctacatcaaacgcgacgaggcgtcggcgtgctggctctgccctgtagaacagtctgcatgatacagcatacagtccacacaataaaccaagctgccaagggccacagctgcttaaatctgggagctgctatacttgtgttatcacgtatatataggcaataaactaataatgccgccaggacacttcactggtggtcatgtgaagttggtagtagaatgcacttgtaacgtgttgttaatttgttatcctgcaatgtacgctctataaactgttcagtatcttgaaagtcttantccnnnnaaaaa

SEQ ID NO: 8 - DNA, 665 bp, Lolium perenne
  misc_feature (2)..(3): n is a, c, g, or t
tnncagacgagtattttatcaagaggaagctgtatccaaatgtggatttttattctggcctaatatatagggcaatgggattccctacagagtttttccctgttctgtttgcagttcctcgcatggctggttggttagcacattggaaggagtcacttgatgaccccgacaataaaattatgaggccccaacaggtatacaccggtacttggctaaggcattacaccccagtgagagaacgggtgccatcaagcgacagtgagcagcttgggcagatcgctacatcaaacgcgacgaggcgtcggcgtgctggctctgccctgtagaacagtctgcatgatacagcatacagtccacacaataaaccaagctgccaagggccacggctgcttaaatctgggagctgctatacttgtgttatcacgtatatataggcaataaactaataatgccgccaggacacttcactggtggtcatgtgaagttggtagtagaatgcacttgtaacgtgttgttaatttgttatcctgcaatgtacgctctataaactgttcagtatcttgaaagtcttaatcatgtggaccaagaagacatagatcaagttctttgcatgggcggcggctgtttctttgtgtttcctctttttatgggagtctttttttacc

SEQ ID NO: 9 - DNA, 597 bp, Lolium perenne
gtcagacgagtattttatcaagaggaagctgtatccaaatgtggatttttattctggcctaatatatagggcaatgggattccctacagagtttttccctgttctgtttgcagttcctcgcatggctggttggttagcacattggaaggagtcacttgatgaccccgacaataaaattatgaggccccaacaggtatacaccggtacttggctaaggcattacaccccagtgagagaacgggtgccatcaagcgacagtgagcagcttgggcagatcgctacatcaaacgcgacgaggcgtcggcgtgctggctctgccctgtagaacagtctgcatgatacagcatacagtccacacaataaaccaagctgccaagggccacggctgcttaaatctgggagctgctatacttgtgttatcacgtatatataggcaataaactaataatgccgccaggacacttcactggtggtcatgtgaagttggtagtagaatgcacttgtaacgtgttgttaatttgttatcctgcaatgtacgctctataaactgttcagtatcttgaaagtcttaatcatgtggaccaatcaaaaaaaaaa

SEQ ID NO: 10 - DNA, 310 bp, Lolium perenne
ggcagatcgctcatcaaacgcgtcgaggcgtcggcgtgctggctctgccctgtagaacagtctgcatgatacagcatacagtccacacaataaaccaagctgccaagggccacggctgcttaaatctgggagctgctatacttgtgttatcacgtatatataggcaataaactaataatgccgccaggacacttcactggtggtcatgtgaagttggtagtagaatgcacttgtaacgtgttgttaatttgttatcctgcaatgtacgctctataaactgttcagtatcttgaaagtcttaaaaaaaaaa

SEQ ID NO: 11 - DNA, 1167 bp, Lolium perenne
  misc_feature (12)..(12): n is a, c, g, or t
  misc_feature (457)..(457): n is a, c, g, or t
  misc_feature (1087)..(1087): n is a, c, g, or t
  misc_feature (1106)..(1106): n is a, c, g, or t
cttctccctgtnactgctctccaatgacacagtttaccactggagtgatggcactccaagttgagagtgaatttgcaaaggcttatgagaagggaattcataaatcaaagttctgggagcctacatatgaagatagcttaaatttgattgctcggcttccacaagtggcttcatatgtttaccggagaattttcaaggacgggaaaactattgcagctgataatacactggactacgcagctaatttttcacacatgcttggttttgatgaccccaaaatgctggagttgatgcgcctatacataacaattcacactgatcacgaaggagggaatgttagtgctcatgctgggcatctggttggaagtgctctgtcagatccttatctttcttttgcagcggcactgaacggtttagctggaccactgcacggcttggctaatcaggaagtgttgtnatggatcaaatctgtgatggaagaaaccgggagtaacattacaactgatcagcttaaagaatatgtttggaagacactgaagagtggaaaggttgttcctggctatggtcatggagttctacgtaatacagatccacgatactcgtgccaaagggagtttgcactgaagtatttacccgaagacccacttttccaactggtctccaagttgtacgaagttgtgcctcctatcctcaccgagttaggcaaggtaaaaaacccatggcctaatgttgatgctcacagtggagttttgctcaaccacttcggattagttgaagcacggtactacactgtcttgttcggcgtctcaaggagcatgggaattggatctcagctcatttgggaccgtgccctcggcctgccacttgaaagaccgaagagtgtcaccatggagtggctggaaaaccactgcaagaaggctgcggcctgaagctacaccaatgcttcgttttacaaatcaggccgtctttgatgttaataatgactgagcataagttaggcatggttagccttgttttaccatcttcgttttcctggccaataactggagcaagaggctcacagacggtagaattttgtaaccaccgntacttgaacaccgaatcanttaaatgtcatttggcataaagagattaggacatgacacataagttttatgtgtcgctcgg

SEQ ID NO: 12 - protein, 308 aa, Lolium perenne
  misc_feature (4)..(4): Xaa can be any naturally occurring amino acid
  misc_feature (152)..(152): Xaa can be any naturally occurring amino acid
SPCXCSPMTQFTTGVMALQVESEFAKAYEKGIHKSKFWEPTYEDSLNLIARLPQVASYVYRRIFKDGKTIAADNTLDYAANFSHMLGFDDPKMLELMRLYITIHTDHEGGNVSAHAGHLVGSALSDPYLSFAAALNGLAGPLHGLANQEVLXWIKSVMEETGSNITTDQLKEYVWKTLKSGKVVPGYGHGVLRNTDPRYSCQREFALKYLPEDPLFQLVSKLYEVVPPILTELGKVKNPWPNVDAHSGVLLNHFGLVEARYYTVLFGVSRSMGIGSQLIWDRALGLPLERPKSVTMEWLENHCKKAAA

SEQ ID NO: 13 - DNA, 802 bp, Lolium perenne
  misc_feature (12)..(12): n is a, c, g, or t
  misc_feature (743)..(743): n is a, c, g, or t
  misc_feature (782)..(782): n is a, c, g, or t
  misc_feature (792)..(792): n is a, c, g, or t
  misc_feature (797)..(797): n is a, c, g, or t
  misc_feature (802)..(802): n is a, c, g, or t
cttctccctgtnactgctctccaatgacacagtttaccactggagtgatggcactccaagttgagagtgaatttgcaaaggcttatgagaagggaattcataaatcaaagttctgggagcctacatatgaagatagcttaaatttgattgctcggcttccacaagtggcttcatatgtttaccggagaattttcaaggacgggaaaactattgcagctgataatacactggactacgcagctaatttttcacacatgcttggttttgatgaccccaaaatgctggagttgatgcgcctatacataacaattcacactgatcacgaaggagggaatgttagtgctcatgctgggcatctggttggaagtgctctgtcagatccttatctttcttttgcagcggcactgaacggtttagctggaccactgcacggcttggctaatcaggaagtgttgttatggatcaaatctgtgatggaagaaaccgggagtaacattacaactgatcagcttaaagaatatgtttggaagacactgaagagtggaaaggttgttcctggctatggtcatggagttctacgtaatacagatccacgatactcgtgccaaagggagtttgcactgaagtatttacctgaagacccacttttccaactggtctccaagttgtatgaagttgtgcctcctatcctcactgagttaggcaaggtaaaaaacccatggcctaatgttgatgctcacagnggagttttgctcaaccacttcggattagttgaacacggnactacactgncttgntcggn

SEQ ID NO: 14 - DNA, 710 bp, Lolium perenne
  misc_feature (2)..(2): n is a, c, g, or t
  misc_feature (9)..(9): n is a, c, g, or t
  misc_feature (630)..(630): n is a, c, g, or t
  misc_feature (649)..(649): n is a, c, g, or t
  misc_feature (703)..(703): n is a, c, g, or t
  misc_feature (706)..(706): n is a, c, g, or t
tnatggatnaatctgtgatggaagaaccgggagtaacattacaactgatcagcttaaagaatatgtttggaagacactgaagagtggaaaggttgttcctggctatggtcatggagttctacgtaatacagatccacgatactcgtgccaaagggagtttgcactgaagtatttacccgaagacccacttttccaactggtctccaagttgtacgaagttgtgcctcctatcctcaccgagttaggcaaggtaaaaaacccatgccctaatgttgatgctcacagtggagttttgctcaaccacttcggattagttgaagcacggtactacactgtcttgttcggcgtctcaaggagcatgggaattggatctcagcccatttgggaccgtgccctcggcctgccacttgaaagaccgaagagtgtcaccatggagtggctggaaaaccactgcaagaaggctgcggcctgaagctacaccaatgcttcgttttacaaatcaggccgtctttgatgttaataatgactgagcataagttaggcatggttagccttgttttaccatcttcgttttcctggccaataactggagcaagaggcttacagacggtagaattttgtaaccaccgntacttgaacaccgaatcanttaaatgtcatttggcataaagagattaggacatgacacataagttttatgtgncgntcgg

SEQ ID NO: 15 - DNA, 633 bp, Lolium perenne
  misc_feature (83)..(83): n is a, c, g, or t
  misc_feature (86)..(86): n is a, c, g, or t
  misc_feature (413)..(413): n is a, c, g, or t
  misc_feature (427)..(427): n is a, c, g, or t
  misc_feature (490)..(490): n is a, c, g, or t
  misc_feature (570)..(570): n is a, c, g, or t
  misc_feature (572)..(573): n is a, c, g, or t
  misc_feature (581)..(581): n is a, c, g, or t
ctgaagagtggaaaggttgttcctggctatggtcatggagttctacgtaatacagatccacgatactcgtgccaaagggagtnggnactgaagtatttacccgaagacccacttttccaactggtctccaagttgtacgaagttgtgcctcctatcctcaccgagttaggcaaggtaaaaaacccatggcctaatgttgatgctcacagtggagttttgctcaaccacttcggattagttgaagcacggtactacactgtcttgttcggcgtctcaaggagcatgggaattggatctcagctcatttgggaccgtgccctcggcctgccacttgaaagaccgaagagtgtcaccatggagtggctggaaaaccactgcaagaaggctgcggcctgaagctacaccaatgcttngttttacaaatcangccgtctttgatgttaataatgactgagcataagttaggcatgggtagccttgttttaccatnttcgttttcctggccaataactggagcaagaggctcacagacggtagaattttgtaaccaccggtacttgacaccgaatnanntaaatggnatttggcataaagagattaggacatgacacataagttttatgtgtcgctcgg

SEQ ID NO: 16 - DNA, 349 bp, Lolium perenne
gtttttggatcccagctcatttgggtccgtgccctcggcctgccacttgaaagaccgaagagtgtcaccatggagtggctggaaaaccactgcaagaaggctgcggcctgaagctacaccaatgcttcgttttacaaatcaggccgtctttgatgttaataatgactgagcataagttaggcatggttagccttgttttaccatcttcgttttcctggccaataactggagcaagaggctcacagacggtagaattttgtaaccaccgttacttgaacaccgaatcagttaaatgtcatttggcataaagagattaggacatgacacataagttttatgtgtcgctcga

SEQ ID NO: 17 - DNA, 635 bp, Lolium perenne
  misc_feature (3)..(3): n is a, c, g, or t
  misc_feature (13)..(13): n is a, c, g, or t
  misc_feature (17)..(17): n is a, c, g, or t
  misc_feature (23)..(23): n is a, c, g, or t
  misc_feature (107)..(107): n is a, c, g, or t
  misc_feature (635)..(635): n is a, c, g, or t
tcnccgtggccanaatnccccancattcaaataccgcccgtcagccaccaatcctcctaccttcttatttccaccccaaccgcccaacatgtgtcctcccaccgaanaaacacctgctaccaacggccatagcaacggcaccaacggcgccaatggctccaaggaaggcttcacaggcgtcacgaccagacagaaccctcaccctacacacaagagcccatatgcacctgttggcgactttttgtcaaatgtcggccgcttcaagattatcgagagcacattaagagagggcgagcaattcgccaacgcctacttcgaccttgaggctaaaatcaagatcgccagagctctcgacaactttggtgttgactacattgaagttaccagccctgctgcctctgagcagtcaagaagggactgcgaagccctctgcaagctcggattgaaagccaagatccttacccacgtacgatgccacatggacgatgccagaatcgctgtcgagactggtgttgacggcctcgatgtcgtcattggaacctctgcgtacctccgcgagcacagccatggcaaggacatgacatacatcaaaaacacagcgctggaggtgattgagtttgtcaagagcaagggan

SEQ ID NO: 18 - protein, 211 aa, Lolium perenne
  misc_feature (1)..(1): Xaa can be any naturally occurring amino acid
  misc_feature (4)..(4): Xaa can be any naturally occurring amino acid
  misc_feature (6)..(6): Xaa can be any naturally occurring amino acid
  misc_feature (8)..(8): Xaa can be any naturally occurring amino acid
  misc_feature (36)..(36): Xaa can be any naturally occurring amino acid
XRGXNXPXFKYRPSATNPPTFLFPPQPPNMCPPTEXTPATNGHSNGTNGANGSKEGFTGVTTRQNPHPTHKSPYAPVGDFLSNVGRFKIIESTLREGEQFANAYFDLEAKIKIARALDNFGVDYIEVTSPAASEQSRRDCEALCKLGLKAKILTHVRCHMDDARIAVETGVDGLDVVIGTSAYLREHSHGKDMTYIKNTALEVIEFVKSKG

SEQ ID NO: 19 - DNA, 636 bp, Lolium perenne
  misc_feature (4)..(4): n is a, c, g, or t
  misc_feature (11)..(11): n is a, c, g, or t
  misc_feature (14)..(14): n is a, c, g, or t
  misc_feature (19)..(19): n is a, c, g, or t
  misc_feature (21)..(21): n is a, c, g, or t
  misc_feature (26)..(26): n is a, c, g, or t
  misc_feature (30)..(30): n is a, c, g, or t
  misc_feature (37)..(37): n is a, c, g, or t
  misc_feature (41)..(41): n is a, c, g, or t
  misc_feature (43)..(44): n is a, c, g, or t
  misc_feature (47)..(47): n is a, c, g, or t
  misc_feature (50)..(50): n is a, c, g, or t
  misc_feature (636)..(636): n is a, c, g, or t
gtgntatggcncanccagnantcctncgtnctggctnccanannagnaanaagctatcggcaacgacctcagcgatcaggccatcaaggactacctgtggtccaccctcaaggctggccaagtcgttcccggttacggacacgccgttctccgcaagaccgacccccgctacgtctcccagcgcgagttcgcccagaagcaccttcccgacgacccaatgttcaagctcgtcagtcaggtctacaagatcgcccctggtgttctcaccgagcacggcaagaccaagaacccctaccccaacgtcgacgcccactccggtgtcctcctccagtactacggcctcactgagcagaactactacaccgttctcttcggtgtatcccgtgcgctcggtgtccttccccagcttatcattgaccgtgccgtcggtgcccccattgagaggcccaagtctttcagcactgaggcttacgccaagttggttggtgctaagttgtaagcgcgttactgcaacgtgctctacagccaggagaatgtggaggaatttgtttaacattcagagataccttgtcctgtgtagaattgcaatgtaaggatagggaatgggagcgttacggcgctacatcactacatttn

SEQ ID NO: 20 - protein, 165 aa, Lolium perenne
  misc_feature (1)..(1): Xaa can be any naturally occurring amino acid
  misc_feature (4)..(7): Xaa can be any naturally occurring amino acid
  misc_feature (9)..(10): Xaa can be any naturally occurring amino acid
  misc_feature (12)..(12): Xaa can be any naturally occurring amino acid
  misc_feature (14)..(17): Xaa can be any naturally occurring amino acid
XYGXXXXPXXWXPXXXXAIGNDLSDQAIKDYLWSTLKAGQVVPGYGHAVLRKTDPRYVSQREFAQKHLPDDPMFKLVSQVYKIAPGVLTEHGKTKNPYPNVDAHSGVLLQYYGLTEQNYYTVLFGVSRALGVLPQLIIDRAVGAPIERPKSFSTEAYAKLVGAKL

SEQ ID NO: 21 - DNA, 696 bp, Lolium perenne
  misc_feature (665)..(665): n is a, c, g, or t
ggttggttgctggtatcaccattctgccctgttctcacaggcaactccttcgactaatgcattgtctagtgaagacatcaaggctctcaccaagaggacacaggagggtgggacagaagttgttgaggcaaaggctggaaagggatctgcaaccttgtccatggcgtatgctggcgcagtttttggtgatgcatgcttgaagggtctgaacggagttcctgacattgttgaatgctcctacgtgcaatcaactatcacagaactgccattctttgcctccaaggtgaggctcgggaagaatggagtcgaggaagtgcttggtttgggtgagctgtcggcctttgagaaggaaggtttggaaagtctcaagggtgagctcaagtcttcaattgacaagggcatcgcgttcgccaatgcgagttaattaattttgcagattatagcaaaccaggtctagttaaggggtctgtttttgactttttgttcagtgctttttctgcccatcacgtgggcatggaagatttgagcttcacaataaaaatccggcggcgtaatgccacagaacattacttgtacaagagggaactagttcgtgtcaagttttgaactggtacattaaacgaacaattgctgatgcactttgagaaaaaaaaattgggggtgantccattggcctcaagccaaaaaaaaaaaaaa

SEQ ID NO: 22 - protein, 140 aa, Lolium perenne
VGCWYHHSALFSQATPSTNALSSEDIKALTKRTQEGGTEVVEAKAGKGSATLSMAYAGAVFGDACLKGLNGVPDIVECSYVQSTITELPFFASKVRLGKNGVEEVLGLGELSAFEKEGLESLKGELKSSIDKGIAFANAS

SEQ ID NO: 23 - DNA, 650 bp, Lolium perenne
  misc_feature (650)..(650): n is a, c, g, or t
gtttggttgctggtatcaccattctgccctgttctcacaggcaactccttcgactaatgcattgtctagtgaagacatcaaggctctcaccaagaggacacaggagggtgggacagaagttgttgaggcaaaggctggaaagggatctgcaaccttgtccatggcgtatgctggcgcagtttttggtgatgcatgcttgaagggtctgaacggagttcctgacattgttgaatgctcctacgtgcaatcaactatcacagaactgccattctttgcctccaaggtgaggctcgggaagaatggagtcgaggaagtgcttggtttgggtgagctgtcggcctttgagaaggaaggtttggaaagtctcaagggtgagctcaagtcttcaattgacaagggcatcgcgttcgccaatgcgagttaattaattttgcagattatagcaaaccaggtctagttaaggggtctgttgtttttgttcagtgctttttctgcccatcacgtgggcatggaagatttgagcttcacaataaaaatccggcggcgtaatgccacagaacattacttgtacaagagggaactagttcgtgtcaagttttgaactggtacattaaacgaacaattgctgatgcactttgagaaaaaaaaan

SEQ ID NO: 24 - DNA, 649 bp, Lolium perenne
ggtggttgctggtatcaccattctgccctgttctcacaggcaactccttcgactaatgcattgtctagtgaagacatcaaggctctcaccaagaggacacaggagggtgggacagaagttgttgaggcaaaggctggaaagggatctgcaaccttgtccatggcgtatgctggcgcagtttttggtgatgcatgcttgaagggtctgaacggagttcctgacattgttgaatgctcctacgtgcaatcaactatcacagaactgccattctttgcctccaaggtgaggctcgggaagaatggagtcgaggaagtgcttggtttgggtgagctgtcggcctttgagaaggaaggtttggaaagtctcaagggtgagctcaagtcttcaattgacaagggcatcgcgttcgccaatgcgagttaattaattttgcagattatagcaaaccaggtctagttaaggggtctgttgtttttgttcagtgctttttctgcccatcacgtgggcatggaagatttgagcttcacaataaaaatccggcggcgtaatgccacagaacattacttgtacaagagggaactagttcgtgtcaagttttgaactggtacattaaacgaacaattgctgatgcactttgagaaaaaaaaaa

SEQ ID NO: 25 - DNA, 649 bp, Lolium perenne
gtggtctgctggtatcaccattctgccctgttctcacaggcaactccttcgactaatgcattgtctagtgaagacatcaaggctctcaccaagaggacacaggagggtgggacagaagttgttgaggcaaaggctggaaagggatctgcaaccttgtccatggcgtatgctggcgcagtttttggtgatgcatgcttgaagggtctgaacggagttcctgacattgttgaatgctcctacgtgcaatcaactatcacagaactgccattctttgcctccaaggtgaggctcgggaagaatggagtcgaggaagtgcttggtttgggtgagctgtcggcctttgagaaggaaggtttggaaagtctcaagggtgagctcaagtcttcaattgacaagggcatcgcgttcgccaatgcgagttaattaattttgcagattatagcaaaccaggtctagttaaggggtctgttgtttttgttcagtgctttttctgcccatcacgtgggcatggaagatttgagcttcacaataaaaatccggcggcgtaatgccacagaacattacttgtacaagagggaactagttcgtgtcaagttttgaactggtacattaaacgaacaattgctgatgcactttgagaaaaaaaaaa

SEQ ID NO: 26 - DNA, 544 bp, Lolium perenne
  misc_feature (469)..(469): n is a, c, g, or t
  misc_feature (475)..(475): n is a, c, g, or t
  misc_feature (479)..(480): n is a, c, g, or t
  misc_feature (502)..(502): n is a, c, g, or t
  misc_feature (508)..(508): n is a, c, g, or t
  misc_feature (522)..(522): n is a, c, g, or t
  misc_feature (526)..(526): n is a, c, g, or t
  misc_feature (529)..(530): n is a, c, g, or t
  misc_feature (534)..(534): n is a, c, g, or t
  misc_feature (537)..(537): n is a, c, g, or t
  misc_feature (543)..(544): n is a, c, g, or t
ggttgctggtatcaccattctgccctgttctcacaggcaactccttcgactaatgcattgtctagtgaagacatcaaggctctcaccaagaggacacaggagggtgggacagaagttgttgaggcaaaggctggaaagggatctgcaaccttgtccatggcgtatgctggcgcagtttttggtgatgcatgcttgaagggtctgaacggagttcctgacattgttgaatgctcctacgtgcaatcaactatcacagaactgccattctttgcctccaaggtgaggctcgggaagaatggagtcgaggaagtgcttggtttgggtgagctgtcggcctttgagaaggaaggtttggaaagtctcaagggtgagctcaagtcttcaattgacaagggcatcgcgttcgccaatgcgagttaattaattttgcagattatagcaaaccaggtctagttaaggggtctgttgnttttgntcanngctttttctgcccatcacgtgngcatgnaagatttgagcttnacantanntatnccngcgcgnn

SEQ ID NO: 27 - DNA, 589 bp, Lolium perenne
  misc_feature (243)..(243): n is a, c, g, or t
  misc_feature (386)..(386): n is a, c, g, or t
  misc_feature (459)..(459): n is a, c, g, or t
  misc_feature (494)..(494): n is a, c, g, or t
  misc_feature (509)..(509): n is a, c, g, or t
  misc_feature (541)..(541): n is a, c, g, or t
  misc_feature (562)..(562): n is a, c, g, or t
  misc_feature (571)..(571): n is a, c, g, or t
  misc_feature (574)..(574): n is a, c, g, or t
  misc_feature (580)..(580): n is a, c, g, or t
gagggtgggacagaagttgttgaggcaaaggctggaaagggatctgcaaccttgtccatggcgtatgctggcgcagtttttggtgatgcatgcttgaagggtctgaacggagttcctgacattgttgaatgctcctatgtgcaatcaactatcacagaactgccattctttgcctccaaggtgaggctcgggaagaatggagtcgaggaagtgcttggtttgggtgagctgtcggcctttganaaggaaggtttggaaagtctcaagggtgagctcaagtcttcaattgacaagggcatcgcgttcgccaatgcgagttgattaaatttgcagattatagcaatccaggtctagttgaggggtctgtttttgactttttgttcagngctttttctgcccatcacgtgggcatggaagatttgagcttcacaataaaaatccggcggcgtaatgccacanaacattacttggacaagagggaactagttcgggtnaagttttgaactggnacattaaacaaccaattgttgtgcccctttgngaaccgccctttgggggtgantccattggnctnaagccnaaaaaaaaa

SEQ ID NO: 28 - DNA, 413 bp, Lolium perenne
  misc_feature (3)..(3): n is a, c, g, or t
  misc_feature (5)..(5): n is a, c, g, or t
  misc_feature (12)..(13): n is a, c, g, or t
  misc_feature (406)..(406): n is a, c, g, or t
  misc_feature (409)..(409): n is a, c, g, or t
gtnangctcggnnagaatggagtcgaggaagtgcttggtttgggtgagctgtcggcctttgagaaggaaggtttggaaagtctcaagggtgagctcaagtcttcaattgacaagggcatcgcgttcgccaatgcgagttgattaaatttgcagattatagcaatccaggtctagttgaggggtctgtttttgactttttgttcagtgctttttctgcccatcacgtgggcatggaagatttgagcttcacaataaaaatccggcggcgtaatgccacagaacattacttgtacaagagggaactagttcgtgtcaagttttgaactggtacattaaacgaacaattgttgatgcactttgtgaaccgtcctttggtgttgattccattgtcttcaagttaacgaanaanaaaa

SEQ ID NO: 29 - DNA, 345 bp, Lolium perenne
  misc_feature (79)..(79): n is a, c, g, or t
aatggagtcgaggaagtgcttggtttgggtgagctgtcggcctttgagaaggaaggtttggaaagtctcaagggtgagntcaagtcttcaattgacaagggcatcgcgttcgccaatgcgagttgattaaatttgcagattatagcaatccaggtctagttgaggggtctgtttttgactttttgttcagtgctttttctgcccatcacgtgggcatggaagatttgagcttcacaataaaaatccggcggcgtaatgccacagaacattacttgtacaagagggaactagttcgtgtcaagttttgaactggtacattaaacgaacaattgttgaaaaaaaaaa

SEQ ID NO: 30 - DNA, 807 bp, Lolium perenne
  misc_feature (7)..(7): n is a, c, g, or t
  misc_feature (49)..(49): n is a, c, g, or t
  misc_feature (503)..(503): n is a, c, g, or t
  misc_feature (506)..(506): n is a, c, g, or t
  misc_feature (656)..(656): n is a, c, g, or t
  misc_feature (678)..(678): n is a, c, g, or t
  misc_feature (807)..(807): n is a, c, g, or t
tttggtncttttgccgagcgagaaagctgttcggtgtcaccacccttgngttgttcgtgctaaaactttctacgctgggaaggcaaacgtgccagtcactggggtgaatgttcctgttgttggtggccatgctggtgttactatcctgccacagttctcacaggctactcctgcaagtaatgcattgtcccatgaggaccttaaggccctcaccaagaggacacaagatggtgggacggaagttgttgaagcaaaggctggaaagggctcagcaacattgtcaatggcatatgctggtgcagtatttggagatgcatgcttgaaggggctcaatggagttcctgacattgtagagtgctcctttgtgcaatcaaccgtaacagagctgccattctttgcctccaaggtaaggctcggcaagaacggagtggaggaagtgattgggctgggcgagctgtctgccttcgagaaggagggtctggagagcctcaagggcgagctgntgncctccatcgagaagggtatcaagttcgcgcaggagagctagtcaacctgctcagattctaacactccgcacatgaactcggtgggatctgatgaatttttggtacgactcctttcactgcccccttctcctggggacattgaggcgtcgngctccacaataaaatggcgtgncttgttgccatactgaactgaacttgtaataccagaaagagtgaaaccctgtgccttatgtaccacagtacggtgaacccgaaaatcatgaaggtagcagaagattctgtggaagcttttttcttttan

SEQ ID NO: 31 - protein, 181 aa, Lolium perenne
  misc_feature (2)..(2): Xaa can be any naturally occurring amino acid
  misc_feature (16)..(16): Xaa can be any naturally occurring amino acid
  misc_feature (168)..(169): Xaa can be any naturally occurring amino acid
LXLLPSEKAVRCHHPXVVRAKTFYAGKANVPVTGVNVPVVGGHAGVTILPQFSQATPASNALSHEDLKALTKRTQDGGTEVVEAKAGKGSATLSMAYAGAVFGDACLKGLNGVPDIVECSFVQSTVTELPFFASKVRLGKNGVEEVIGLGELSAFEKEGLESLKGELXXSIEKGIKFAQES

SEQ ID NO: 32 - DNA, 708 bp, Lolium perenne
  misc_feature (7)..(7): n is a, c, g, or t
  misc_feature (19)..(19): n is a, c, g, or t
  misc_feature (21)..(21): n is a, c, g, or t
  misc_feature (48)..(48): n is a, c, g, or t
  misc_feature (502)..(502): n is a, c, g, or t
  misc_feature (505)..(505): n is a, c, g, or t
  misc_feature (655)..(655): n is a, c, g, or t
  misc_feature (677)..(678): n is a, c, g, or t
  misc_feature (693)..(693): n is a, c, g, or t
  misc_feature (702)..(702): n is a, c, g, or t
  misc_feature (708)..(708): n is a, c, g, or t
tttggtncttttgccgagnantaatctgttcggtgtcaccacccttgngttgttcgtgctaaaactttctacgctgggaaggcaaacgtgccagtcactggggtgaatgttcctgttgttggtggccatgctggtgttactatcctgccactgttctcacaggctactcctgcaagtaatgcattgtcccatgaggatcttaaggccctcaccaagaggacacaagatggtgggacggaagttgttgaagcaaaggctggaaagggctcagcaacattgtcaatggcatatgctggtgcagtatttggagatgcatgcttgaaggggctcaatggagttcctgacattgtagagtgctcctttgtgcaatcaactgtaacagagctgccattctttgcctccaaggtaaggctcggcaagaacggagtggaggaagtgattgggctgggcgagctgtctgccttcgagaaggagggtctggagagcctcaagggcgagctgntgncctccatcgagaagggtatcaagttcgcgcaggagagctagtcaacctgctcagattctgacactccgtacatgaactcggtgggatctgatgaatttttggtacgactcctttctctgcccctttttcgtggggacattgaggcgttgngcttcacattaaaatggcgtgnnttgttgcatactganctgaccttntattcn

SEQ ID NO: 33 - DNA, 790 bp, Lolium perenne
  misc_feature (790)..(790): n is a, c, g, or t
gcgagagagctgtttggtgtcaccacccttgtgttgttcgtgctaaaactttctacgctgggaaggcaaacgtgcccgtcactggggtgaatgttcctgttgttggtggccatgctggtgttactatcctgccacagttctcacaggctactcctgcaagtaatgcattgtcccatgaggaccttaaggccctcaccaagaggacacaagatggtgggacggaagttgttgaagcaaaggctggaaagggctcagcaacattgtcgatggcatatgctggtgcagtttttggagatgcatgcttgaaggggctcaatggagttcctgacattgtagagtgctcctttgtgcaatcaaccgtaacagagctgccattctttgcctccaaggtaaggctcggcaagaacggagtggaggaagtgattgggctgggcgagctgtctgccttcgagaaggagggtctggagagcctcaagggcgagctgttgtcctccattgagaagggtatcaagttcgctcaggagagctagtcaacctgctcagattctaacactccgcacatgaactcggtgggatctgatgaatttttggttcgactcctttcactgcccccttctcctggggacattgaggcgtcgtgctccacaataaaatggcgtgtcttgttgccatactgaactgaacttgtaataccagaaagagtgaaaccctgtgccttatgtaccacagtacggtgaacccgaaaatcatgaaggtagcagaagattctgtggaagcttttttcttttan

SEQ ID NO: 34 - DNA, 419 bp, Lolium perenne
  misc_feature (2)..(3): n is a, c, g, or t
  misc_feature (7)..(7): n is a, c, g, or t
  misc_feature (18)..(18): n is a, c, g, or t
  misc_feature (27)..(27): n is a, c, g, or t
  misc_feature (48)..(48): n is a, c, g, or t
  misc_feature (75)..(75): n is a, c, g, or t
  misc_feature (77)..(77): n is a, c, g, or t
  misc_feature (99)..(99): n is a, c, g, or t
  misc_feature (198)..(198): n is a, c, g, or t
  misc_feature (227)..(228): n is a, c, g, or t
  misc_feature (232)..(232): n is a, c, g, or t
  misc_feature (244)..(244): n is a, c, g, or t
  misc_feature (275)..(275): n is a, c, g, or t
  misc_feature (305)..(305): n is a, c, g, or t
  misc_feature (309)..(309): n is a, c, g, or t
  misc_feature (339)..(339): n is a, c, g, or t
  misc_feature (342)..(342): n is a, c, g, or t
  misc_feature (348)..(348): n is a, c, g, or t
  misc_feature (385)..(385): n is a, c, g, or t
  misc_feature (419)..(419): n is a, c, g, or t
gnnggtntaccgagcgcncatactttngtgggtgaggttcttggactngacccaagagatgtcaatgttcctgtngntggcgggcatgccggagttacnatattgccactcctttcgcaggttaatcctccctgctcattcaccatgaggaaattagtatctcaccttcacagcatacagaatggtgggacagaagtngtcgaggcgaaagctggagcaggatcggnnactntttctatggcgnatgcggcagctaaatttgcagatgcttgctngagaggattgcatggtgatgctgggatagnggantgctcttatgtggattctcaggtgacgganctntctttntttgcatccaaagttcgccttggttgttctggcgtcnaggagatcttgccacttggtccactcaacgagtn

SEQ ID NO: 35 - protein, 139 aa, Lolium perenne
  misc_feature (1)..(1): Xaa can be any naturally occurring amino acid
  misc_feature (3)..(3): Xaa can be any naturally occurring amino acid
  misc_feature (6)..(6): Xaa can be any naturally occurring amino acid
  misc_feature (9)..(9): Xaa can be any naturally occurring amino acid
  misc_feature (16)..(16): Xaa can be any naturally occurring amino acid
  misc_feature (25)..(26): Xaa can be any naturally occurring amino acid
  misc_feature (33)..(33): Xaa can be any naturally occurring amino acid
  misc_feature (66)..(66): Xaa can be any naturally occurring amino acid
  misc_feature (76)..(76): Xaa can be any naturally occurring amino acid
  misc_feature (78)..(78): Xaa can be any naturally occurring amino acid
  misc_feature (82)..(82): Xaa can be any naturally occurring amino acid
  misc_feature (92)..(92): Xaa can be any naturally occurring amino acid
  misc_feature (102)..(103): Xaa can be any naturally occurring amino acid
  misc_feature (113)..(114): Xaa can be any naturally occurring amino acid
  misc_feature (116)..(116): Xaa can be any naturally occurring amino acid
  misc_feature (129)..(129): Xaa can be any naturally occurring amino acid
XGXPSXHTXVGEVLGXDPRDVNVPXXGGHAGVXILPLLSQVNPPCSFTMRKLVSHLHSIQNGGTEXVEAKAGAGSXTXSMAXAAAKFADACXRGLHGDAGIXXCSYVDSQVTXXSXFASKVRLGCSGVXEILPLGPLNE

SEQ ID NO: 36 - DNA, 774 bp, Lolium perenne
  misc_feature (2)..(2): n is a, c, g, or t
  misc_feature (4)..(4): n is a, c, g, or t
  misc_feature (774)..(774): n is a, c, g, or t
gngnttccgccaacacaacaccaccgctcccccgtccgcatctctccctttcgcctccatcgatccagatcccacacaccgccgcagccagcaacgatgaggccgtcggcgatgagatccgccgcgcagctcctccgccgccgcagctactcgtccgcgtccggccagccggagcggaaggtggccatcctcggcgcggccggcgggatcgggcagccgctggcgctcctcatgaagctgaacccgctcgtctcctccctctccctctacgacatcgccgccacccccggcgtcgccgccgacgtctcccacatcaactccccggccctggtgaaggggttcatgggcgacgatcagctcgcggaggcgttggagggggccgacctcgtcatcatcccggccggcgttccgaggaagcccggcatgaccagggacgatctcttcaacatcaacgccggcatcgttaagaacctctgcaccgccatcgccaagtactgccccaacgctcttatcaacatgatcagcaaccctgtgaactcaactgttccaattgctgctgaagttttcaagaaggctggaacctatgatgagaagaagttgtttggtgtgaccactcttgatgttgttcgtgccaggactttctatgctgggaaggctaatgtacctgttactggtgtgaacgttcctgttgttggtggtcatgctggtatcaccattctgccactgttctcacaggcaactccttcgactaatgcattgtctagtgaagacatn

SEQ ID NO: 37 - protein, 258 aa, Lolium perenne
  misc_feature (1)..(2): Xaa can be any naturally occurring amino acid
  misc_feature (258)..(258): Xaa can be any naturally occurring amino acid
XXPPTQHHRSPVRISPFRLHRSRSHTPPQPATMRPSAMRSAAQLLRRRSYSSASGQPERKVAILGAAGGIGQPLALLMKLNPLVSSLSLYDIAATPGVAADVSHINSPALVKGFMGDDQLAEALEGADLVIIPAGVPRKPGMTRDDLFNINAGIVKNLCTAIAKYCPNALINMISNPVNSTVPIAAEVFKKAGTYDEKKLFGVTTLDVVRARTFYAGKANVPVTGVNVPVVGGHAGITILPLFSQATPSTNALSSEDX

SEQ ID NO: 38 - DNA, 816 bp, Lolium perenne
  misc_feature (8)..(8): n is a, c, g, or t
  misc_feature (504)..(504): n is a, c, g, or t
  misc_feature (516)..(516): n is a, c, g, or t
  misc_feature (526)..(526): n is a, c, g, or t
  misc_feature (529)..(529): n is a, c, g, or t
  misc_feature (558)..(558): n is a, c, g, or t
  misc_feature (572)..(572): n is a, c, g, or t
  misc_feature (640)..(640): n is a, c, g, or t
  misc_feature (653)..(653): n is a, c, g, or t
  misc_feature (679)..(679): n is a, c, g, or t
  misc_feature (682)..(682): n is a, c, g, or t
  misc_feature (701)..(701): n is a, c, g, or t
  misc_feature (721)..(721): n is a, c, g, or t
  misc_feature (755)..(755): n is a, c, g, or t
  misc_feature (764)..(764): n is a, c, g, or t
  misc_feature (766)..(766): n is a, c, g, or t
  misc_feature (782)..(782): n is a, c, g, or t
  misc_feature (793)..(793): n is a, c, g, or t
  misc_feature (798)..(798): n is a, c, g, or t
  misc_feature (806)..(807): n is a, c, g, or t
  misc_feature (816)..(816): n is a, c, g, or t
tccgtacnattgctgctgaagtatttaaaaaagctgggacatacaatcctaagagattgttgggggtgacaacacttgatgtagtgagagccaatacttttgtgggtgaggttcttggacttgaccccagagatgtcaatgttcctgttgttggcgggcatgccggagttacgatattaccactcctttcgcaggttagtcctccctgctcgttcacccctgaggaaattagttatctcacctcacgcatacagaatggtgggacagaagttgtggaggcgaaagcaggagcaggatcggcaactctttctatggcgtatgcggcagctaaatttgcagatgcttgcttgagaggattgcatggtgatgctgggatagtggagtgctcttatgtggattctcaggtgaccggaactgccttctttgcatccaaagttcgcctaggtcgttctggcgtcgaggagatcttgcaacttgggtccactgaaccaggttttgaaaganctggactggaanaaggcgaaanaangagctatcccgagagccttccagaaaggntgtgtcatttcgtncaacaaagtgagttacatgccatcatctttgttggatgtgcttccccaaagttccaacacaccgtcgnaattggcatatanatattgctggtttggggccttttgcnttnatgcaaacaggctaccttntgggtggggggggtccgttntgaaaaactcttaacatttttttttacggttggnaacaaaatntntgaaaagcctgagaantatatgataantgaanaaagtttnnaaaaaaaan

SEQ ID NO: 39 - protein, 271 aa, Lolium perenne
  misc_feature (2)..(2): Xaa can be any naturally occurring amino acid
  misc_feature (168)..(168): Xaa can be any naturally occurring amino acid
  misc_feature (172)..(172): Xaa can be any naturally occurring amino acid
  misc_feature (175)..(176): Xaa can be any naturally occurring amino acid
  misc_feature (186)..(186): Xaa can be any naturally occurring amino acid
  misc_feature (190)..(190): Xaa can be any naturally occurring amino acid
  misc_feature (213)..(213): Xaa can be any naturally occurring amino acid
  misc_feature (217)..(217): Xaa can be any naturally occurring amino acid
  misc_feature (226)..(227): Xaa can be any naturally occurring amino acid
  misc_feature (233)..(233): Xaa can be any naturally occurring amino acid
  misc_feature (240)..(240): Xaa can be any naturally occurring amino acid
  misc_feature (251)..(251): Xaa can be any naturally occurring amino acid
  misc_feature (254)..(255): Xaa can be any naturally occurring amino acid
  misc_feature (260)..(260): Xaa can be any naturally occurring amino acid
  misc_feature (264)..(264): Xaa can be any naturally occurring amino acid
  misc_feature (266)..(266): Xaa can be any naturally occurring amino acid
  misc_feature (268)..(269): Xaa can be any naturally occurring amino acid
RXIAAEVFKKAGTYNPKRLLGVTTLDVVRANTFVGEVLGLDPRDVNVPVVGGHAGVTILPLLSQVSPPCSFTPEEISYLTSRIQNGGTEVVEAKAGAGSATLSMAYAAAKFADACLRGLHGDAGIVECSYVDSQVTGTAFFASKVRLGRSGVEEILQLGSTEPGFERXGLEXGEXXSYPESLPERXCHFXQQSELHAIIFVGCASPKFQHTVXIGIXILLVWGLLXXCKQATXWVGGVRXEKLLTFFFTVXNKXXEKPEXYMIXEXSXXKK

SEQ ID NO: 40 - DNA, 798 bp, Lolium perenne
  misc_feature (10)..(10): n is a, c, g, or t
  misc_feature (13)..(13): n is a, c, g, or t
  misc_feature (134)..(134): n is a, c, g, or t
  misc_feature (233)..(233): n is a, c, g, or t
  misc_feature (248)..(248): n is a, c, g, or t
  misc_feature (260)..(260): n is a, c, g, or t
  misc_feature (301)..(301): n is a, c, g, or t
  misc_feature (499)..(499): n is a, c, g, or t
  misc_feature (633)..(633): n is a, c, g, or t
gggatgattnatncaacaaaaatgctgggcattgtccgatcaatctgtgagggcgttgccaagagctgtcctaatgcaatagtgaatttgatcagcaaccctgtgaactcaactgtccccattgcggcagaagntttcaagagggctggaacttactgccccaaacgtctccttggagtgacaactcttgatgtagcgagggctaacacctttgtggctgaagtgcttggagntgatcctagagaagncagtgttccggntgttggcgggcatgcagggatcactatattgcccctcctgncccaggtcagccccccgtgctcattcactccagatgaaatcagctatttgactaaccgcatacagaatggcggtaccgaagttgttgaggcaaaggctggagcaggctctgcaactttgtcaatggcttttgctgctgcaaaattcgccgatgcatgcttgcgtggaatgcgtggtgatgctggcattgtggaatgtncatacgttgcatctgaggtgacagagctgccgttctttgcaacaaaagtgaggttaggtcgtggcggagctgaggagatcctccctcttgggccactgaatgactttgagagagctggcctggagaaggcgaanaaggagctcagcgagagcatccagaagggtgtggcgttcatgaacaagtgagatcatatgaatggatggataccccgcaacctatacatagatgatgcaaagactaaagaaagagtgtgatatagtgctcctatatacctgtaaaatctctcctgcctgtaagaa

SEQ ID NO: 41 - protein, 220 aa, Lolium perenne
  misc_feature (38)..(38): Xaa can be any naturally occurring amino acid
  misc_feature (71)..(71): Xaa can be any naturally occurring amino acid
  misc_feature (76)..(76): Xaa can be any naturally occurring amino acid
  misc_feature (80)..(80): Xaa can be any naturally occurring amino acid
  misc_feature (94)..(94): Xaa can be any naturally occurring amino acid
  misc_feature (160)..(160): Xaa can be any naturally occurring amino acid
  misc_feature (204)..(204): Xaa can be any naturally occurring amino acid
MLGIVRSICEGVAKSCPNAIVNLISNPVNSTVPIAAEXFKRAGTYCPKRLLGVTTLDVARANTFVAEVLGXDPREXSVPXVGGHAGITILPLLXQVSPPCSFTPDEISYLTNRIQNGGTEVVEAKAGAGSATLSMAFAAAKFADACLRGMRGDAGIVECXYVASEVTELPFFATKVRLGRGGAEEILPLGPLNDFERAGLEKAXKELSESIQKGVAFMNK

SEQ ID NO: 42 - DNA, 798 bp, Lolium perenne
  misc_feature (2)..(4): n is a, c, g, or t
  misc_feature (10)..(10): n is a, c, g, or t
  misc_feature (13)..(13): n is a, c, g, or t
  misc_feature (130)..(130): n is a, c, g, or t
  misc_feature (134)..(134): n is a, c, g, or t
  misc_feature (230)..(230): n is a, c, g, or t
  misc_feature (233)..(233): n is a, c, g, or t
  misc_feature (248)..(248): n is a, c, g, or t
  misc_feature (260)..(260): n is a, c, g, or t
  misc_feature (276)..(276): n is a, c, g, or t
  misc_feature (301)..(301): n is a, c, g, or t
  misc_feature (633)..(633): n is a, c, g, or t
gnnntgattnatncaacaaaaatgctgggcattgtccgatcaatctgtgagggcgttgccaagagctgtcctaatgcaatagtgaatttgatcagcaaccctgtgaactcaactgtccccattgcggcanaagntttcaagagggctggaacttactgccccaaacgtctccttggagtgacaactcttgatgtagcgagggctaacacctttgtggctgaagtgcttgnagntgatcctagagaagncagtgttccggntgttggcgggcatgcngggatcactatattgcccctcctgncccaggtcagccccccgtgctcattcactccagatgaaatcagctatttgactaaccgcatacagaatggcggtaccgaagttgttgaggcaaaggctggagcaggctctgcaactttgtcaatggcttttgctgctgcaaaattcgccgatgcatgcttgcgtggaatgcgtggtgatgctggcattgtggaatgttcatacgttgcatctgaggtgacagagctgccgttctttgcaacaaaagtgaggttaggtcgtggcggagctgaggagatcctccctcttgggccactgaatgactttgagagagctggcctggagaaggcgaanaaggagctcagcgagagcatccagaagggtgtggcgttcatgaacaagtgagatcatatgaatggatggataccccgcaacctatacatagatgatgcaaagactaaagaaagagtgtgatatagtgctcctatatacctgtaaaatctctcctgcctgtaagaa

SEQ ID NO: 43 - DNA, 497 bp, Lolium perenne
  misc_feature (484)..(484): n is a, c, g, or t
  misc_feature (497)..(497): n is a, c, g, or t
ggatgatttattcaacaaaaatgctgggattgtccgatcaatctgtgagggcgttgccaagagctgtcctaatgcaatagtgaatttgatcagcaaccctgtgaactcaactgtccccattgcggcagaagttttcaagagggctggaacttactgccccaaacgtctccttggagtgacaactcttgatgtagcgagggctaacacctttgtggctgaagtgcttggagttgatcctagagaagtcagtgttccggttgttggcgggcatgcagggatcactatattgcccctcctgtcccaggtcagccccccgtgctcattcactccagatgaaatcagctatttgactaaccgcatacagaatggcggtaccgaagttgttgaggcaaaggctggagcaggctctgcaactttgtcaatggcttttgctgctgcaaaattcgccgatgcatgcttgcgtggaatgcgtggtgatgctggnattgtggaatgtn

SEQ ID NO: 44 - DNA, 667 bp, Lolium perenne
  misc_feature (643)..(643): n is a, c, g, or t
  misc_feature (658)..(658): n is a, c, g, or t
caattgcacgttcttgctcacttcagcatcaccctcacgcttctcctacacaacccctcccaaccgtcactatggtcaaggctgtcgtcgcaggtgctgctggtggtatcggccagcccctctctcttctactcaagacgagccccctcatcgatgagcttgccctctacgatgttgtcaacactcccggtgttgccgctgatctttcccacatctcatcccgcgctcaaatcgccggctacctccccaaggatgatggcgcaaaggctgcattcaaagatgccgacattatcgtcatccccgccggcattcctcgcaagcctggcatgacccgtgatgacctcttcaacatcaacgccggaattgtcaagggtctgattgaggttgccgccgaagttgcccccaaggccttcattctggtcatctccaaccctgtcaactctaccgtccctatctctgccgaggtcctcaaggccaagggcgtcttcaaccctcagcgtcttttcggtgtcaccaccctcgacatcgtccgtgccgagactttcgtcgccagcatcaccggcgagaagcagccccagaacttgaccgtccccgtcattggcggccactccggcgagaccatcgtcccgcttttcagcaaggntcagccctctgcttncattcccgc

SEQ ID NO: 45 - protein, 221 aa, Lolium perenne
  misc_feature (214)..(214): Xaa can be any naturally occurring amino acid
  misc_feature (219)..(219): Xaa can be any naturally occurring amino acid
IARSCSLQHHPHASPTQPLPTVTMVKAVVAGAAGGIGQPLSLLLKTSPLIDELALYDVVNTPGVAADLSHISSRAQIAGYLPKDDGAKAAFKDADIIVIPAGIPRKPGMTRDDLFNINAGIVKGLIEVAAEVAPKAFILVISNPVNSTVPISAEVLKAKGVFNPQRLFGVTTLDIVRAETFVASITGEKQPQNLTVPVIGGHSGETIVPLFSKXQPSAXIP

SEQ ID NO: 46 - DNA, 1484 bp, Lolium perenne
  misc_feature (2)..(2): n is a, c, g, or t
tnacggagctgcttaaatcagcccccattccgcctcgtctatagcgatccttcatcccgttgtcgtcgcctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttctcggaacccctgagggaacatttgtttccatgggtgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcggaggagaaggctctcgcctactcgtgcctcgagtaactgcataccagggagcagctgccgctctgatgttttgaataaaaggaacattttggctccatgaaactcatctccactcagaacagttgcacatcgcggtgcctttagctggtttttccagtgtgtatgaatgaggcttttgtagctctattttcgcctgatgatttacaggacaggatattggcaggaagattggaacaatttgacgtctgattaaaaccaacctcttattattcctgtgtgtatgaatgaggcttttgtagctctattttcgcctgatgatttacaggccatgatattggcaggaggattggaacaatttgacgcctgattaaaaccaacctcttattactaaaaaaaaaaaa

SEQ ID NO: 47 - protein, 333 aa, Lolium perenne
MAAKEPMRVLVTGAAGQIGYALVPMIARGIMLGADQPVILHMLDIPPAAEALNGVKMELVDAAFPLLKGVVATTDVVEACTGVNVAVMVGGFPRKEGMERKDVMSKNVSIYKSQASALEAHAAPNCKVLVVANPANTNALILKEFAPSIPEKNISCLTRLDHNRALGQISERLDVQVSDVKNVIIWGNHSSSQYPDVNHATVKTSSGEKPVRELVKDDEWLNAGFIATVQQRGAAIIKARKLSSALSAASSACDHIRDWVLGTPEGTFVSMGVYSDGSYGVPAGLIYSFPVTCCGGEWTIVQGLPIDEFSRKKMDATAQELSEEKALAYSCLE

SEQ ID NO: 48 - DNA, 770 bp, Lolium perenne
  misc_feature (2)..(2): n is a, c, g, or t
  misc_feature (639)..(639): n is a, c, g, or t
  misc_feature (658)..(658): n is a, c, g, or t
  misc_feature (687)..(687): n is a, c, g, or t
tnacggagctgcttaaatcagcccccattccgcctcgtctcactatccttcatcccgttgtcgtcgcctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgnccaagttagtgatgtgaanaatgttatcatctggggcaatcactcttncagtcagtaccctgatgtgaaccacgccaccgtgaagacttccagtgccgagaagcctgttcgcgaacttgttaaagacgatg

SEQ ID NO: 49 - DNA, 335 bp, Lolium perenne
  misc_feature (4)..(4): n is a, c, g, or t
  misc_feature (14)..(14): n is a, c, g, or t
  misc_feature (16)..(16): n is a, c, g, or t
  misc_feature (18)..(18): n is a, c, g, or t
  misc_feature (25)..(25): n is a, c, g, or t
  misc_feature (34)..(34): n is a, c, g, or t
  misc_feature (42)..(42): n is a, c, g, or t
  misc_feature (57)..(57): n is a, c, g, or t
  misc_feature (269)..(269): n is a, c, g, or t
  misc_feature (274)..(274): n is a, c, g, or t
  misc_feature (282)..(282): n is a, c, g, or t
  misc_feature (327)..(327): n is a, c, g, or t
  misc_feature (329)..(329): n is a, c, g, or t
gggntttacctgtncnancccgtgncgtttgctnctgcccgnaaccactctccccanccccgaactccagaaccggctccaatggcggcgaaggaaccgatgcgcgtgctcgtcaccggcgccgtaggacaaattggatatgctcttgttccgatgattgctaggggaattatgcttggtgcggaccagcctgttattctgcatatgctggatattccaccagctgctgaagctcttaatggtgttaagatggagttggttgatgccgnatttncacttttnaagggagttgttgcaacaactgatgttgttgaggcttgcactggngngaatgt

SEQ ID NO: 50 - DNA, 282 bp, Lolium perenne
  misc_feature (2)..(2): n is a, c, g, or t
  misc_feature (10)..(10): n is a, c, g, or t
  misc_feature (13)..(13): n is a, c, g, or t
  misc_feature (20)..(20): n is a, c, g, or t
  misc_feature (24)..(24): n is a, c, g, or t
  misc_feature (257)..(258): n is a, c, g, or t
  misc_feature (260)..(260): n is a, c, g, or t
  misc_feature (267)..(267): n is a, c, g, or t
  misc_feature (271)..(272): n is a, c, g, or t
  misc_feature (277)..(277): n is a, c, g, or t
  misc_feature (282)..(282): n is a, c, g, or t
gngtatcctntgntacacgntgtncgttcgcctcctcccgacccactctccccatcccccaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattgcaccagctgctgaagctcttaatggcgttaacatggaagtgnntnggcggcntagnnctttntcgcn

SEQ ID NO: 51 - DNA, 202 bp, Lolium perenne
  misc_feature (11)..(11): n is a, c, g, or t
  misc_feature (17)..(18): n is a, c, g, or t
  misc_feature (22)..(22): n is a, c, g, or t
  misc_feature (44)..(44): n is a, c, g, or t
  misc_feature (162)..(162): n is a, c, g, or t
  misc_feature (175)..(175): n is a, c, g, or t
  misc_feature (194)..(194): n is a, c, g, or t
gtttaccgttnctaccnntgtncgttcgcctcctcccgaaaacnctccccatccccgaactccagaaccggctccaatggcggcgaaggaaccgatgcgcgtgctcgtcaccggcgccgcaggacaaattggatatgctcttgttccgatgattgctaggcnaattatgcttggngtgcactagcctgttattntgcatatc

SEQ ID NO: 52 - DNA, 650 bp, Lolium perenne
  misc_feature (2)..(3): n is a, c, g, or t
  misc_feature (10)..(10): n is a, c, g, or t
  misc_feature (13)..(13): n is a, c, g, or t
  misc_feature (46)..(46): n is a, c, g, or t
  misc_feature (50)..(51): n is a, c, g, or t
  misc_feature (88)..(88): n is a, c, g, or t
gnntaccttnctncccgttgtcgtcgcctcctcccgaaccactctncccnnccccgaactccagaaccggctccaatggcggcgaagnaaccgatgcgcgtgctcgtcaccggcgccgcaggacaaattggatatgctcttgttccgatgattgctaggggaattatgcttggtgtggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgcccaagttagtgatgtgaagaatgttatcatctggggcaatcactcttccag

SEQ ID NO: 53 - DNA, 660 bp, Lolium perenne
  misc_feature (2)..(3): n is a, c, g, or t
  misc_feature (5)..(5): n is a, c, g, or t
  misc_feature (10)..(10): n is a, c, g, or t
  misc_feature (37)..(37): n is a, c, g, or t
gnntnccttnctcccgttgtcgtcgcctcctcccganccactctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctga

SEQ ID NO: 54 - DNA, 693 bp, Lolium perenne
  misc_feature (24)..(24): n is a, c, g, or t
  misc_feature (443)..(443): n is a, c, g, or t
  misc_feature (524)..(524): n is a, c, g, or t
  misc_feature (533)..(533): n is a, c, g, or t
  misc_feature (569)..(569): n is a, c, g, or t
  misc_feature (591)..(591): n is a, c, g, or t
  misc_feature (600)..(600): n is a, c, g, or t
  misc_feature (614)..(614): n is a, c, g, or t
  misc_feature (660)..(660): n is a, c, g, or t
  misc_feature (675)..(676): n is a, c, g, or t
  misc_feature (680)..(680): n is a, c, g, or t
gctttccttatcccgttgtcgctnctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgacgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccnaattgcaaggttctggttgttgccaatccagcaaacaccaatgctcttatcttaaaggagtttgctccatctattcctganaagaacatnagttgtttgacccgcctagaccataacagggcactnggtcagatctctgagagacttnatgtccaanttagtgatgtgaanaatgttatcatctggggtaatcacccttccagtcaataccctgatntgaaccacccccccnnaaanacttccagggcga

SEQ ID NO: 55 - DNA, 793 bp, Lolium perenne
  misc_feature (747)..(747): n is a, c, g, or t
gctatccttcatcccgttgtcgtcgcctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggntcattgccactgtccagcagcgtggtgctgcaatcatcaaagcgag

SEQ ID NO: 56 - DNA, 797 bp, Lolium perenne
  misc_feature (744)..(744): n is a, c, g, or t
  misc_feature (773)..(773): n is a, c, g, or t
  misc_feature (790)..(790): n is a, c, g, or t
gctatccttcatcccgttgtcgtcgcctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcgtttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccaggggcgagaagcctgttcgcgaacttgttaaagacgatgaatggctaaatgcangggtcattgccactgtccagcagcgtggngctgcaatcatcaaagngaggaac

SEQ ID NO: 57 - DNA, 684 bp, Lolium perenne
  misc_feature (1)..(1): n is a, c, g, or t
  misc_feature (8)..(8): n is a, c, g, or t
  misc_feature (11)..(11): n is a, c, g, or t
  misc_feature (681)..(681): n is a, c, g, or t
ntaccttnctncccgttgtcgtcgcctcctcccgaaccactctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagccgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaanact

SEQ ID NO: 58 - DNA, 707 bp, Lolium perenne
  misc_feature (2)..(3): n is a, c, g, or t
gnntaccttctccccctgtcgtcacctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttc

SEQ ID NO: 59 - DNA, 801 bp, Lolium perenne
  misc_feature (685)..(685): n is a, c, g, or t
  misc_feature (799)..(799): n is a, c, g, or t
ctatccttatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcgtttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttncagtggcgagaagcctgttcgcgaacttgttaaagacgatgaatggctaaatgcagggttcattgccactgtccagcagcgtggtgctgcaatcatcaaagcgaggaagctctnca

SEQ ID NO: 60 - DNA, 563 bp, Lolium perenne
gatccttatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacaggc

SEQ ID NO: 61 - DNA, 692 bp, Lolium perenne
  misc_feature (2)..(3): n is a, c, g, or t
  misc_feature (34)..(34): n is a, c, g, or t
  misc_feature (692)..(692): n is a, c, g, or t
gnnaccttctcccgttgtcgtcgcctcctcccgnaccactctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttccagtcaataccctgatgtgaaccacgccaccgtgaagacttccagtggn

SEQ ID NO: 62 - DNA, 764 bp, Lolium perenne
gatccttcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagttcgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcag

SEQ ID NO: 63 - DNA, 769 bp, Lolium perenne
  misc_feature (2)..(2): n is a, c, g, or t
gntccttcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagaggcttgatgtccaagttagtgatgtgaagaatgttatcatctggggtaatcactcttccagtcaataccctgatgtgaaccacgccaccgtgaagacttccagtggcgagaagcctgttcgcgaacttgttaaagacgatgaatggctaaatgcagggttcattgccactgtccagcagcgtgg

SEQ ID NO: 64 - DNA, 770 bp, Lolium perenne
  misc_feature (763)..(763): n is a, c, g, or t
gatccttatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcancgtggtg

SEQ ID NO: 65 - DNA, 779 bp, Lolium perenne
  misc_feature (2)..(2): n is a, c, g, or t
gntccctcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcgacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagtaaacaccaatgctcttatcctaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttccagtcaataccctgatgtgaaccacgccaccgtgaagacttccagtggcgagaagcctgttcgcgaacttgttaaagacgatgaatggctaaatgcagggttcattgccactgtccagcagcgtggtgctgcaatc

SEQ ID NO: 66 - DNA, 788 bp, Lolium perenne
  misc_feature (2)..(3): n is a, c, g, or t
  misc_feature (643)..(643): n is a, c, g, or t
gnnccttcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatccgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttncagtcagtaccctgatgtgaaccacgccaccgtgaagacttccagtggcgagaagcctgttcgcgaacttgttaaagacgatgaatggctaaatgcagggttcattgccactgtccaacagcgtggtgctgcaatcatcaaagcg

SEQ ID NO: 67 - DNA, 794 bp, Lolium perenne
  misc_feature (8)..(8): n is a, c, g, or t
gttccttntcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagaggcttgatgtccaagttagtgatgtgaagaatgttatcatctggggtaatcactcttccagtcaataccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagc

SEQ ID NO: 68 - DNA, 797 bp, Lolium perenne
  misc_feature (2)..(2): n is a, c, g, or t
  misc_feature (489)..(489): n is a, c, g, or t
  misc_feature (734)..(734): n is a, c, g, or t
  misc_feature (757)..(757): n is a, c, g, or t
  misc_feature (776)..(776): n is a, c, g, or t
gntccttcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatccgcccttgaagcccatgcagccccgaattgcaaggttctggttgttgccaatccagcaaacaccaatgctnttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctnaatgcagggttcattgccactgnccagcagcgtggtgctgcnatcatcaaagcgaggaagctt

SEQ ID NO: 69 - DNA, 802 bp, Lolium perenne
  misc_feature (222)..(222): n is a, c, g, or t
  misc_feature (685)..(685): n is a, c, g, or t
  misc_feature (770)..(770): n is a, c, g, or t
gatccttcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaanctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttncagtggcgagaagcctgttcgcgaacttgttaaagacgatgaatggctaaatgcagggttcattgccactgtccagcagcgtggngctgcatcatcaaagcgaggaagctcttcagt

SEQ ID NO: 70 - DNA, 315 bp, Lolium perenne
  misc_feature (2)..(2): n is a, c, g, or t
  misc_feature (7)..(7): n is a, c, g, or t
  misc_feature (13)..(13): n is a, c, g, or t
  misc_feature (153)..(153): n is a, c, g, or t
  misc_feature (257)..(257): n is a, c, g, or t
  misc_feature (302)..(302): n is a, c, g, or t
gnccttnatcccnttgtcgtcgcctcctcccgaccactctccccatccccgaactccagaaccggctccaatggcggccaaggaaccgatgcgcgtgctcgtcaccggcgccgcaggacaaattggatatgctcttgttccgatgattgctangggaattatgcttggtgcggaccagcctgttattctgcatatgctggatattccaccagctgctgaagctcttaatggtgttaagatggagttggttgatgccncatttccacttctcaagggagttgttgcaacaactgatgttgttnaggcttgcactgg

SEQ ID NO: 71 - DNA, 525 bp, Lolium perenne
  misc_feature (2)..(2): n is a, c, g, or t
  misc_feature (23)..(23): n is a, c, g, or t
  misc_feature (26)..(26): n is a, c, g, or t
  misc_feature (78)..(78): n is a, c, g, or t
  misc_feature (269)..(269): n is a, c, g, or t
  misc_feature (493)..(493): n is a, c, g, or t
  misc_feature (515)..(515): n is a, c, g, or t
gntccttatcccgttgtcgtcgnctnctcccgaccactctccccatccccgaactccagaaccggctccaatggcggngaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttntcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatnttaaaggagtttgctccatctnttcctgagaa

SEQ ID NO: 72 - DNA, 696 bp, Lolium perenne
  misc_feature (7)..(7): n is a, c, g, or t
  misc_feature (547)..(547): n is a, c, g, or t
  misc_feature (603)..(603): n is a, c, g, or t
  misc_feature (613)..(613): n is a, c, g, or t
  misc_feature (632)..(632): n is a, c, g, or t
  misc_feature (642)..(642): n is a, c, g, or t
  misc_feature (646)..(646): n is a, c, g, or t
  misc_feature (674)..(674): n is a, c, g, or t
  misc_feature (681)..(681): n is a, c, g, or t
  misc_feature (683)..(683): n is a, c, g, or t
  misc_feature (691)..(691): n is a, c, g, or t
ttccttnctcccgttgtcgtcgcctcctcccgaaccactctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagatgtttgacccgnctagaccataacagggcactcggtcagatctctgagagacttgatgtgcaagttancgatgtgaanaatgctatcatctgggganatcactcttncagncataccctgatgtgaaccacgccaccgngaacacntncactgccnacaag

SEQ ID NO: 73 - DNA, 646 bp, Lolium perenne
  misc_feature (6)..(6): n is a, c, g, or t
tccttnatcccgttgtcgtcgcctcctcccgaaccctctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaaaaatgttatcatctggggcaatcactcttccagtc

SEQ ID NO: 74 - DNA, 711 bp, Lolium perenne
  misc_feature (8)..(8): n is a, c, g, or t
  misc_feature (642)..(642): n is a, c, g, or t
  misc_feature (679)..(679): n is a, c, g, or t
accttctncccgttgtcgtcgcctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttncagtcaataccctgatgtgaaccacgccaccgtgaanactttcagtggcgagaagcctgttcgcgaact

SEQ ID NO: 75 - DNA, 768 bp, Lolium perenne
  misc_feature (6)..(6): n is a, c, g, or t
tccttntcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtg

SEQ ID NO: 76 - DNA, 783 bp, Lolium perenne
tccttatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaag

SEQ ID NO: 77 - DNA, 803 bp, Lolium perenne
  misc_feature (7)..(7): n is a, c, g, or t
  misc_feature (713)..(713): n is a, c, g, or t
  misc_feature (797)..(797): n is a, c, g, or t
tccttcntcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagaggcttgatgtccaagttagtgatgtgaagaatgttatcatctggggtaatcactcttccagtcaataccctgatgtgaaccacgccaccgtgaagacttccagtggcgagaagcctgttcgcgaacttgntaaagacgatgaatggctaaatgcagggttcattgccactgtccagcagcgtggtgctgcaatcatcaaagcgaggaagctctncagtgc

SEQ ID NO: 78 - DNA, 595 bp, Lolium perenne
  misc_feature (386)..(386): n is a, c, g, or t
  misc_feature (439)..(439): n is a, c, g, or t
  misc_feature (496)..(496): n is a, c, g, or t
  misc_feature (510)..(510): n is a, c, g, or t
  misc_feature (520)..(520): n is a, c, g, or t
  misc_feature (529)..(529): n is a, c, g, or t
  misc_feature (531)..(531): n is a, c, g, or t
  misc_feature (558)..(558): n is a, c, g, or t
  misc_feature (561)..(562): n is a, c, g, or t
  misc_feature (567)..(567): n is a, c, g, or t
  misc_feature (578)..(578): n is a, c, g, or t
  misc_feature (580)..(580): n is a, c, g, or t
  misc_feature (588)..(588): n is a, c, g, or t
  misc_feature (590)..(590): n is a, c, g, or t
  misc_feature (595)..(595): n is a, c, g, or t
ccttcatcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaanaatgtttcaatctacaaatcttaagcatctgcccttgaagcccatgcaccccnaattgcaagggtctggttgttgccaatccagcaaacaccaatgcttttattttaaangagtttgctccatntattcctganaagaacatnanttgtttgacccgcctagaccataacanggnncttgncaaaatctttnanagacttgntntcaan

SEQ ID NO: 79 - DNA, 696 bp, Lolium perenne
  misc_feature (1)..(1): n is a, c, g, or t
  misc_feature (11)..(11): n is a, c, g, or t
  misc_feature (120)..(120): n is a, c, g, or t
  misc_feature (335)..(335): n is a, c, g, or t
  misc_feature (387)..(387): n is a, c, g, or t
  misc_feature (482)..(482): n is a, c, g, or t
  misc_feature (603)..(603): n is a, c, g, or t
  misc_feature (608)..(608): n is a, c, g, or t
  misc_feature (612)..(612): n is a, c, g, or t
  misc_feature (674)..(674): n is a, c, g, or t
  misc_feature (689)..(689): n is a, c, g, or t
  misc_feature (695)..(696): n is a, c, g, or t
nccttctcccnttgtcgtcgcctcctcccgaaccactctccccatccccgaactccagaaccggctccaatggcggcgaaggaaccgatgcgcgtgctcgtcaccggcgccgcaggacanattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggntggtggattccccaggaaggagggaatggaaaggaaggatgttatgtctaanaatgtttcaatctacaaatctcaagcatctgcccttgaagcccatgcagccccgaattgcaaggttctggttgttgccaatccagcaaacaccantgctcttatcttaaaggagtttgctccatctatccctgagaagaacatcagttgtttgacccgcctagaccataacagggcacttggtcagatctctgagagacttgatgtccaagttagngatgngaanaatgttatcatctggggcaatcactcttccagtcagtaccctgatgtgaaccacgccaccgngaagacttccagtgncgagann

SEQ ID NO: 80 - DNA, 779 bp, Lolium perenne
  misc_feature (77)..(77): n is a, c, g, or t
accttatcccgttgtcgtcgcctcctcccgaccactctccccatccccgaactccagaaccggctccaacggcggcnaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacgactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcata

SEQ ID NO: 81 - DNA, 470 bp, Lolium perenne
  misc_feature (4)..(4): n is a, c, g, or t
  misc_feature (44)..(44): n is a, c, g, or t
cttnctcccgttgtcgtcgcctcctcccgaaccactctcccctnccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatcca

SEQ ID NO: 82 - DNA, 599 bp, Lolium perenne
  misc_feature (3)..(3): n is a, c, g, or t
  misc_feature (6)..(6): n is a, c, g, or t
  misc_feature (10)..(10): n is a, c, g, or t
  misc_feature (44)..(44): n is a, c, g, or t
  misc_feature (580)..(580): n is a, c, g, or t
ttnctnccgnctgtcgtcgcctcctcccgaaccactctcccctnccccgaactccaaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctganagacttgatgtccaagtta

SEQ ID NO: 83 - DNA, 606 bp, Lolium perenne
  misc_feature (3)..(3): n is a, c, g, or t
  misc_feature (6)..(6): n is a, c, g, or t
  misc_feature (12)..(12): n is a, c, g, or t
  misc_feature (43)..(44): n is a, c, g, or t
  misc_feature (545)..(545): n is a, c, g, or t
  misc_feature (569)..(569): n is a, c, g, or t
ttnctncccccngtcgtcgcctcctcccgaaccactctccccnnccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgctgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgnctagaccataacagggcactcggncagatctctgagagacttgatgtccaagttagtgatg

SEQ ID NO: 84 - DNA, 686 bp, Lolium perenne
  misc_feature (1)..(1): n is a, c, g, or t
  misc_feature (33)..(33): n is a, c, g, or t
nttcatcccgttgtcgtcgcctcctcccgaacnctctccccatccccgaactccagaaccggctccaatggcggcgaaggaaccgatgcgcgtgctcgtcaccggcgccgcaggacaaattggatatgctcttgttccgatgattgctaggggaattatgctcggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagactttcagtgg

SEQ ID NO: 85 - DNA, 341 bp, Lolium perenne
  misc_feature (9)..(9): n is a, c, g, or t
  misc_feature (17)..(17): n is a, c, g, or t
  misc_feature (22)..(22): n is a, c, g, or t
  misc_feature (98)..(98): n is a, c, g, or t
  misc_feature (150)..(150): n is a, c, g, or t
  misc_feature (175)..(175): n is a, c, g, or t
  misc_feature (276)..(276): n is a, c, g, or t
  misc_feature (279)..(279): n is a, c, g, or t
  misc_feature (297)..(297): n is a, c, g, or t
  misc_feature (305)..(305): n is a, c, g, or t
ttcatcccnttgtcgtngcctnctcccgaaccactctccccttccccgaactccagaaccggctccaatggcggcgaaggaaccgatgcgcgtgctcntcaccggcgccgcaggacaaattggatatgctcttgttccgatgattgctangggaattatgcttggtgcggaccancctgttattctgcatatgctggatattccaccagctgctgaagctcttaatggtgttaagatggagttggttgatgccgcatttccacttctcaagggagntgntgcaacaactgatgttgntgaggctngcactggtgtgaatgttgcggttatggatggtggat

SEQ ID NO: 86 - DNA, 349 bp, Lolium perenne
  misc_feature (245)..(245): n is a, c, g, or t
  misc_feature (265)..(265): n is a, c, g, or t
  misc_feature (278)..(278): n is a, c, g, or t
  misc_feature (294)..(294): n is a, c, g, or t
  misc_feature (300)..(300): n is a, c, g, or t
  misc_feature (312)..(312): n is a, c, g, or t
  misc_feature (326)..(328): n is a, c, g, or t
  misc_feature (331)..(331): n is a, c, g, or t
  misc_feature (333)..(334): n is a, c, g, or t
  misc_feature (340)..(340): n is a, c, g, or t
  misc_feature (345)..(345): n is a, c, g, or t
  misc_feature (348)..(349): n is a, c, g, or t
ttgatcccgttgtcgtcgcctcctcccgaaccctctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgcaggatattccaccagctgctgaagctcttaatggtgttaagatggagttggntgatgccgcatttccacttntcaagggagttgntgcaacaactgatgtngttgangcttgcactggngtgaatgttgcggnnntgncnngcccangtaanatnn

SEQ ID NO: 87 - DNA, 605 bp, Lolium perenne
  misc_feature (1)..(1): n is a, c, g, or t
  misc_feature (32)..(32): n is a, c, g, or t
  misc_feature (499)..(499): n is a, c, g, or t
  misc_feature (522)..(522): n is a, c, g, or t
  misc_feature (531)..(531): n is a, c, g, or t
  misc_feature (559)..(559): n is a, c, g, or t
  misc_feature (567)..(567): n is a, c, g, or t
  misc_feature (572)..(572): n is a, c, g, or t
  misc_feature (584)..(584): n is a, c, g, or t
  misc_feature (596)..(596): n is a, c, g, or t
  misc_feature (598)..(598): n is a, c, g, or t
  misc_feature (600)..(600): n is a, c, g, or t
  misc_feature (602)..(602): n is a, c, g, or t
  misc_feature (605)..(605): n is a, c, g, or t
nttatcccgctgtcgtcgcctcctcccgaacnctctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcccgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagnttgctccatctattcctgagaanaacatcagntgtttgacccgcctagaccataacaggncactcggncaganctctgagagacntgatgcccaagntngngntgn

SEQ ID NO: 88 - DNA, 685 bp, Lolium perenne
  misc_feature (1)..(1): n is a, c, g, or t
nttatcccgttgtcgtcgcctcctcccgaaccctctccccatccccgaactccgaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctgggcaaatcactcttccagtcagtaccctgatgtgaaccacgccaccgtgaagacttccagtgg

SEQ ID NO: 89 - DNA, 763 bp, Lolium perenne
  misc_feature (4)..(4): n is a, c, g, or t
ctcntcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtg

SEQ ID NO: 90 - DNA, 790 bp, Lolium perenne
  misc_feature (3)..(3): n is a, c, g, or t
ttntcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagct

SEQ ID NO: 91 - DNA, 690 bp, Lolium perenne
  misc_feature (678)..(678): n is a, c, g, or t
ttctcccgttgtcgtcgcctcctcccgaccactctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttccagtcaataccctgatgtgaaccacgccaccgtgaagacttncagtggcgagaa

SEQ ID NO: 92 - DNA, 700 bp, Lolium perenne
  misc_feature (679)..(679): n is a, c, g, or t
ttctcccgttgtcgtcgcctcctcccgaaccactctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttccagtcaataccctgatgtgaaccacgccaccgtgaagacttncagtggcgagaagcctgttcg

SEQ ID NO: 93 - DNA, 679 bp, Lolium perenne
  misc_feature (515)..(515): n is a, c, g, or t
  misc_feature (524)..(524): n is a, c, g, or t
  misc_feature (526)..(526): n is a, c, g, or t
  misc_feature (571)..(571): n is a, c, g, or t
  misc_feature (575)..(575): n is a, c, g, or t
  misc_feature (596)..(596): n is a, c, g, or t
  misc_feature (617)..(617): n is a, c, g, or t
  misc_feature (627)..(627): n is a, c, g, or t
  misc_feature (631)..(631): n is a, c, g, or t
  misc_feature (643)..(643): n is a, c, g, or t
  misc_feature (660)..(660): n is a, c, g, or t
  misc_feature (671)..(671): n is a, c, g, or t
tcccgttgtcgtcgcctcctcccgaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaaaaatgtttcaatctacaaatctcaagcatctgcccttgaagcccatgcagccccgaattgcaaggttctggttgttgccaatccagcaaacaccaatgcttttatcttaaaggagtttgctccatctattcctganaagaacatnanttgtttgacccgcctaaaccataacagggcacttggtcagatctntganagacttgatggccaagttagngatgtgaaaaatgttatcatntggggcaatnactnttccagtcagtnccctgatgtgaaccacncccccggaaanacttccag

SEQ ID NO: 94 - DNA, 676 bp, Lolium perenne
  misc_feature (27)..(27): n is a, c, g, or t
  misc_feature (676)..(676): n is a, c, g, or t
cgttgtcgtcgcctcctcccgaccctnctcccctccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagtatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagn

SEQ ID NO: 95 - DNA, 786 bp, Lolium perenne
ccgttgtcgtcgcctcctcccgaaccactctccccatccccgaactccagaaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttatttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagct

SEQ ID NO: 96 - DNA, 772 bp, Lolium perenne
  misc_feature (29)..(29): n is a, c, g, or t
ggaccctctccccatccccgaactccagnaccggctccaatggcggcgaaggaaccgatgcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggatcccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaggacttccagtggcgagaagcctgttcgcgaacttgttaaagacgatgaatggctaaatgcagggttcattgccactgtccagcagcgtggtgctgcaatcatcaaagcgaggaagctctccagtg

SEQ ID NO: 97 - DNA, 676 bp, Lolium perenne
  misc_feature (1)..(1): n is a, c, g, or t
  misc_feature (7)..(7): n is a, c, g, or t
  misc_feature (9)..(9): n is a, c, g, or t
  misc_feature (14)..(14): n is a, c, g, or t
  misc_feature (36)..(36): n is a, c, g, or t
nccccgnantccanaccggctccaaggcggcgaagnaaccgagcgcgtgctcgtcaccggcgccgcaggacaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgtaaggttctggttgttgccaatccagcaaacaccaatgctcttatcttaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttccagtcaataccctgatgtgaaccacgccaccgtgaagacttccagtggcgagaagcctgttcgcgaacttgttaaagacgat

SEQ ID NO: 98 - DNA, 763 bp, Lolium perenne
  misc_feature (36)..(36): n is a, c, g, or t
ggaccgatgcccgtgctcgtcaccggcgccgcaggncaaattggatatgctcttgttccgatgattgctaggggaattatgcttggtgcggaccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggaatggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgatt

SEQ ID NO: 99 - DNA, 513 bp, Lolium perenne
  misc_feature (435)..(435): n is a, c, g, or t
  misc_feature (453)..(453): n is a, c, g, or t
  misc_feature (458)..(458): n is a, c, g, or t
  misc_feature (469)..(469): n is a, c, g, or t
  misc_feature (472)..(472): n is a, c, g, or t
  misc_feature (482)..(482): n is a, c, g, or t
  misc_feature (485)..(486): n is a, c, g, or t
  misc_feature (488)..(488): n is a, c, g, or t
  misc_feature (491)..(491): n is a, c, g, or t
  misc_feature (500)..(501): n is a, c, g, or t
  misc_feature (503)..(503): n is a, c, g, or t
  misc_feature (506)..(506): n is a, c, g, or t
  misc_feature (511)..(511): n is a, c, g, or t
tatgcttggtgcggccagcctgttattctgcatatgctggatattccaccagctgctgaagctcttaatggtgttaagatggagttggttgatgccgcatttccacttctcaagggagttgttgcaacaactgatgttgttgaggcttgcactggtgtgaatgttgcggttatggttggtggattccccaggaaggagggagtggaaaggaaggatgttatgtctaagaatgtttcaatctacaaatctcaagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtncaagttagtgatgtgaanaatgntatcatctggncanctcactcttncanncnttnccctgatgnnanccncgccncg

SEQ ID NO: 100 - DNA, 664 bp, Lolium perenne
  misc_feature (2)..(2): n is a, c, g, or t
  misc_feature (83)..(83): n is a, c, g, or t
  misc_feature (85)..(86): n is a, c, g, or t
  misc_feature (241)..(241): n is a, c, g, or t
  misc_feature (534)..(534): n is a, c, g, or t
  misc_feature (570)..(570): n is a, c, g, or t
  misc_feature (576)..(576): n is a, c, g, or t
  misc_feature (605)..(605): n is a, c, g, or t
  misc_feature (610)..(610): n is a, c, g, or t
  misc_feature (620)..(620): n is a, c, g, or t
  misc_feature (640)..(640): n is a, c, g, or t
  misc_feature (650)..(650): n is a, c, g, or t
  misc_feature (653)..(653): n is a, c, g, or t
  misc_feature (657)..(657): n is a, c, g, or t
  misc_feature (660)..(660): n is a, c, g, or t
tnggttggtggattccccaggaaggagggaatggaaaggaaggatgttatgtctaagaatgtttcaatctacaaatctcaagngnntgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcacttggtnagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctttccagtgctctttttgctgccagctctgcttgtgaccacatccgggattgggttctcggaacccctganggaacatttgtttccatgggtgtgtattctgatggntatacngggtgcctggtgggcttatctactccttnccagnaacttgctgngggggggaatggacaattgntcaaaggctnccnatcnacnagtt

SEQ ID NO: 101 - DNA, 734 bp, Lolium perenne
  misc_feature (722)..(722): n is a, c, g, or t
taagcatctgcccttgaagcccatgcagccccgaattgcaaggttctggttgttgccaatccagcaaacaccaatgctcttatcttaaaggagtttgctccatctattcctgagaagaacatcagttgtttgacccgcctagaccataacagggcactcggtcagatctctgagagacttgatgtccaagttagtgatgtgaagaatgttatcatctggggtaatcactcttccagtcaataccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttcttggaacccctgagggaacatttgtttccatgggtgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcggaggagaaggctctcgcctactcgtgcctcgagtaactgcataccagggagcagctgccgctctgatgttttgaataaaaggaacattttggctncatgaaactcat

SEQ ID NO: 102 - DNA, 705 bp, Lolium perenne
  misc_feature (14)..(14): n is a, c, g, or t
  misc_feature (16)..(16): n is a, c, g, or t
  misc_feature (456)..(456): n is a, c, g, or t
  misc_feature (608)..(608): n is a, c, g, or t
  misc_feature (689)..(689): n is a, c, g, or t
  misc_feature (698)..(698): n is a, c, g, or t
  misc_feature (701)..(701): n is a, c, g, or t
ccatgcaaccccgnantgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttctcggaacccctgagggaacatttgtttccatggntgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcgnaggagaaggctctcgcctactcgtgcctcgagtaactgcataccagggagcagctgtcgctctgatgttttgaataaaagnacattttgnctncatg

SEQ ID NO: 103 - DNA, 667 bp, Lolium perenne
tgcagccccgattgcaaggttctggttgttgccaatccagcaaacaccaatgctcttatcttaaaggagtttgctccatctattcctgagaagaacatcagttgtttgacccgcctagaccataacagggcacttggtcagatctctgagagacttgatgtccaagttagtgatgtgaagaatgttatcatctggggcaatcactcttccagtcagtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttctcggaacccctgagggaacatttgtttccatgggtgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcggaggagaaggctctcgcctactcgtgcctcgagtaactgcataccagggagcagctgccgctct

SEQ ID NO: 104 - DNA, 748 bp, Lolium perenne
  misc_feature (28)..(28): n is a, c, g, or t
gcaatcactcttccagtcagtaccctgngtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttctcggaacccctgagggaacatttgtttccatgggtgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcggaggagaaggctctcgcctactcgtgcctcgagtaactgcataccagggagcagctgccgctctgatgttttgaataaaaggaacattttggctccatgaaactcatctccactcagaacagttgcacatcgcggtgcctttagctggtttttccagtgtgtatgaatgaggcttttgtagctctattttcgcctgatgatttacaggacaggatattggcaggaagattggaacaatttgacgtctgattaaaaccaacctcttattattcccgtgtgtatgaatgaggcttttgtagctctattttcgcctgatgatttacaggccatgatattggcagg

SEQ ID NO: 105 - DNA, 646 bp, Lolium perenne
gtaccctgatgtgaaccacgccaccgtgaagacttccagtggcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttctcggaacccctgagggaacatttgtttccatgggtgtgtattctgatggttcatacggtgtgcctgctgggcttatctactccttcccagtaacttgctgcggtggtgaatggacaattgttcaagggctcccggtcgacgagttctcaagaaagaagatggatgccacagcccaggagctctcggaggagaaggctcttgcctactcgtgcctcgagtaactgcataccagggagcagctgccgctctgatgttttgaataaaaggaacattttggctccatgaaactcatctccactcagaacagttgcacatcgcggtgcctttagctggtttttccagtgtgtatgaatgaggcttttgtagctctattttcgcctgatgatttacaggacaggatattggcaggaagattggaacaatttgacgtctgattaaaacca

SEQ ID NO: 106 - DNA, 750 bp, Lolium perenne
  misc_feature (4)..(4): n is a, c, g, or t
  misc_feature (82)..(82): n is a, c, g, or t
ttcngtggcaagagcctgttcgcgacttgttaaagacgatgaatggctaaatgcagggttcattgccactgtccagcagcgnggtgctgcaatcatcaaagcgaggaagctctccagtgctctctctgctgccagctctgcttgtgaccacatccgtgattgggttctcggaacccctgagggaacatttgtttccatgggtgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcggaggagaaggctctcgcctactcgtgcctcgagtaactgcataccagggagcagctgccgctctgatgttttgaataaaaggaacattttggctccatgaaactcatctccactcagaacagttgcacatcgcggtgccttcagctggtttttccagtgtgtatgaatgaggcttttgtagctctattttcgcctgatgatttacaggacaggatattggcaggaagattggaacaatttgacgtctgattaaaaccaacctcttattattcctgtgtgtatgaatgaggcttttgtagctctattttcgcctgatgatttacaggccatgatattggcaggaggattggaacaatttgacgcctgattaaaaccaacctcttattactaaaaaaaaa

SEQ ID NO: 107 - DNA, 616 bp, Lolium perenne
gcgagaagcctgttcgcgaacttgttaaagacgatgaatggctaaatgcagggttcattgccactgtccagcagcgtggtgctgcaatcatcaaagcgaggaagctctccagtgctctctctgctgccagctctgcttgtgaccacatccgtgattgggttctcggaacccctgagggaacatttgtttccatgggtgtgtattctgatggttcatacggtgtgcctgctgggcttatctactccttcccagtaacttgctgcggtggtgaatggacaattgttcaagggctcccgatcgacgagttctcaagaaagaagatggatgccacagcccaggagctctcggaggagaaggctctcgcctactcgtgcctcgagtaactgcataccagggagcagctgccgctctgatgttttgaataaaaggaacattttggctccatgaaactcatctccactcagaacagttgcacatcgcggtgcctttagctggtttttccagtgtgtatgaatgaggcttttgtagcgctattttcgcctgatgatttacaggacaggatattggcaggaagattggaacaatttgacgtctgattaaaaccaacctcttatta

SEQ ID NO: 108 - DNA, 418 bp, Lolium perenne
  misc_feature (69)..(69): n is a, c, g, or t
  misc_feature (223)..(223): n is a, c, g, or t
  misc_feature (412)..(413): n is a, c, g, or t
  misc_feature (415)..(415): n is a, c, g, or t
  misc_feature (417)..(418): n is a, c, g, or t
ccttcccgaaacccgagttctcttttagagaggacgccacagcccaggagctctcggaggagaaggttntcgcctactcgggcctcgagtaactgcataccagggagcagctgccgctctgatgttttgaataaaaggaacattttggctccatgaaactcatctccactcagaacagttgcacatcgcggtgcctttagctggtttttccagtgtgtatgantgaggcttttgtagctctattttcgcctgatgatttacaggacaggatattggcaggaagattggaacaatttgacgtctgattaaaaccaacctcttattattcctgtgtgtatgaatgaggcttttgtagctctattttcgcctgatgatttacaggacatgatattggcaggaggattggaacaannanann

SEQ ID NO: 109 - DNA, 265 bp, Lolium perenne
cctcggaggagaaggctctcgcctactcgtgcctcgagtaactgcataccagggagcagctgccgctctgatgttttgaataaaaggaacattttggctccatgaaactcatctccactcagaacagttgcacatcgcggtgcctttagctggtttttccagtgtgtatgaatgaggcttttgtagctctattttcgcctgatgatttacaggacaggatattggcaggaagattggaacaatttgacgtctgacaaaaaaaaaa

SEQ ID NO: 110 - DNA, 236 bp, Lolium perenne
  misc_feature (2)..(2): n is a, c, g, or t
  misc_feature (6)..(6): n is a, c, g, or t
  misc_feature (33)..(33): n is a, c, g, or t
gnaagnagcttttgtagctctattttcgcctgnagatttacaggacaggatattggcaggaagattggaacaatttgacgtctgattaaaaccaacctcttatattcctgtgtgtatgaatgaggcttttgtagctctattttcgcctgatgatttacaggccacgatattggcaggaggattggaacaatttgacgcctgattaaaaccaacctcttattattctaaaaaaaaaa

SEQ ID NO: 111 - DNA, 177 bp, Lolium perenne
  misc_feature (3)..(3): n is a, c, g, or t
  misc_feature (25)..(25): n is a, c, g, or t
  misc_feature (30)..(30): n is a, c, g, or t
  misc_feature (106)..(106): n is a, c, g, or t
  misc_feature (133)..(133): n is a, c, g, or t
  misc_feature (137)..(137): n is a, c, g, or t
  misc_feature (142)..(143): n is a, c, g, or t
  misc_feature (145)..(145): n is a, c, g, or t
  misc_feature (155)..(155): n is a, c, g, or t
  misc_feature (163)..(163): n is a, c, g, or t
  misc_feature (165)..(166): n is a, c, g, or t
  misc_feature (168)..(168): n is a, c, g, or t
  misc_feature (175)..(175): n is a, c, g, or t
  misc_feature (177)..(177): n is a, c, g, or t
gtncataaagctgcccaaagcaatncgtgnaatattatcagtaaccctgtcaattctaccgtaccaattgctgctgaagtatttaaaaaagctgggacatacaatnctaagagattgttgggggttgacaacngttngatgnnantgacagaccntgctcttngnngncgaggtncn

SEQ ID NO: 112 - protein, 58 aa, Lolium perenne
  misc_feature (1)..(1): Xaa can be any naturally occurring amino acid
  misc_feature (9)..(10): Xaa can be any naturally occurring amino acid
  misc_feature (36)..(36): Xaa can be any naturally occurring amino acid
  misc_feature (45)..(46): Xaa can be any naturally occurring amino acid
  misc_feature (48)..(49): Xaa can be any naturally occurring amino acid
  misc_feature (52)..(52): Xaa can be any naturally occurring amino acid
  misc_feature (55)..(56): Xaa can be any naturally occurring amino acid
XHKAAQSNXXNIISNPVNSTVPIAAEVFKKAGTYNXKRLLGVDNXXMXXTDXALXXRG

SEQ ID NO: 113 - DNA, 664 bp, Lolium perenne
  misc_feature (2)..(2): n is a, c, g, or t
  misc_feature (40)..(40): n is a, c, g, or t
  misc_feature (568)..(568): n is a, c, g, or t
  misc_feature (582)..(582): n is a, c, g, or t
anaaaggagccgacgcaggggcgcagaattccatctgctnactctgccaccacccaagttggacatggcgtcagctgttacaatcagttcagtcagcgcgcaggccgctttggtttcaaaaccaaggaaccatggcagcacgagctacagtggcctaaaggcatcatcgtcgtcgatcagcttcgaatcaggaacatcattcctgggcaagaccgcctccctccgggcaactgttaccacaagggttgtgccaaaggcgaagtctgggtcgcagatatcgcctcaggcatcttacaaggtggcggtgcttggtgctgctggtggcatcggtcaaccactgggcctgctgatcaagatgtctcctctggtctcggagctgcgcctgtatgatatcgcgaatgtcaagggcgtcgctgcagatctcagccactgcaacacgcctgctcaggtcatggacttcactggccccgcagagctagcagagtgcttgaaaggtgtggatgttgtcgtcatccctgcgggtgtcccaaggaagccaggcatgacccgtgatgacctttttaacatnaatgcgggaatcgncaagtcgcttattgaggctgttgcagacaattgccctgagggccttattcatatcatcaacaaccccggtcaaactccccct

SEQ ID NO: 114 - protein, 221 aa, Lolium perenne
  misc_feature (1)..(1): Xaa can be any naturally occurring amino acid
  misc_feature (13)..(13): Xaa can be any naturally occurring amino acid
  misc_feature (189)..(189): Xaa can be any naturally occurring amino acid
  misc_feature (194)..(194): Xaa can be any naturally occurring amino acid
XRSRRRGAEFHLXTLPPPKLDMASAVTISSVSAQAALVSKPRNHGSTSYSGLKASSSSISFESGTSFLGKTASLRATVTTRVVPKAKSGSQISPQASYKVAVLGAAGGIGQPLGLLIKMSPLVSELRLYDIANVKGVAADLSHCNTPAQVMDFTGPAELAECLKGVDVVVIPAGVPRKPGMTRDDLFNXNAGIXKSLIEAVADNCPEGLIHIINNPGQTPP

SEQ ID NO: 115 - DNA, 1263 bp, Lolium perenne
  misc_feature (2)..(2): n is a, c, g, or t
  misc_feature (7)..(7): n is a, c, g, or t
  misc_feature (11)..(11): n is a, c, g, or t
  misc_feature (16)..(16): n is a, c, g, or t
  misc_feature (24)..(24): n is a, c, g, or t
  misc_feature (26)..(26): n is a, c, g, or t
  misc_feature (44)..(44): n is a, c, g, or t
  misc_feature (47)..(47): n is a, c, g, or t
  misc_feature (59)..(60): n is a, c, g, or t
  misc_feature (67)..(67): n is a, c, g, or t
  misc_feature (1179)..(1179): n is a, c, g, or t
  misc_feature (1242)..(1242): n is a, c, g, or t
tntttancccnccaantatccagnanccacctggccctacacanaanaaaaacaaaaannaaccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcagagctaacacatttgtagctcagaagaagaacctcagcctcatcgatgttgatgtcccagttgtcggtggccatgctgggatcacgattctgcctctgttgtccaagactaggccttctgtcagcttcacggacgaggaaactgaacagctgacaaagaggatacagaacgctgggacagaggcggtggaggcgaaggctggtgctggctctgctactctgtccatggcttatgccgctgccagatttgttgagtcatcgctccgcgcaatggctggtgatccagatgtttacgagtgcacgtatgttcagtctgagttaacagagcttccattcttcgcgtccagagttaagcttgggaaggacggngttgagtccatcatttcctccgacctggagggagtgacggagtacgaggccaaggcgcttgangcattgaaggctgagctgaag

SEQ ID NO: 116 - protein, 421 aa, Lolium perenne
  misc_feature (1)..(1): Xaa can be any naturally occurring amino acid
  misc_feature (3)..(4): Xaa can be any naturally occurring amino acid
  misc_feature (6)..(6): Xaa can be any naturally occurring amino acid
  misc_feature (8)..(9): Xaa can be any naturally occurring amino acid
  misc_feature (15)..(16): Xaa can be any naturally occurring amino acid
  misc_feature (20)..(20): Xaa can be any naturally occurring amino acid
  misc_feature (23)..(23): Xaa can be any naturally occurring amino acid
  misc_feature (393)..(393): Xaa can be any naturally occurring amino acid
  misc_feature (414)..(414): Xaa can be any naturally occurring amino acid
XLXXQXSXXHLALHXXKTKXNQXARGEPGRTQQFPSAHQPKLEMASAVTISSVSAQAALVSKPRNHGSTSYSGLKASSSSISFESGTSFLGKTASLRATITSRIVPKAKSGSQISPQASYKVAVLGAAGGIGQPLGLLIKMSPLVSELRLYDIANVKGVAADLSHCNTPSQVMDFTGPAELADCLKGVDVVVIPAGVPRKPGMTRDDLFNINAGIVKSLIEAVADNCPEAFIHIISNPVNSTVPIAAEILKQKGVYNPKKLFGVSTLDVVRANTFVAQKKNLSLIDVDVPVVGGHAGITILPLLSKTRPSVSFTDEETEQLTKRIQNAGTEAVEAKAGAGSATLSMAYAAARFVESSLRAMAGDPDVYECTYVQSELTELPFFASRVKLGKDXVESIISSDLEGVTEYEAKALXALKAELK

SEQ ID NO: 117 - DNA, 711 bp, Lolium perenne
  misc_feature (2)..(2): n is a, c, g, or t
  misc_feature (7)..(7): n is a, c, g, or t
  misc_feature (11)..(11): n is a, c, g, or t
  misc_feature (16)..(16): n is a, c, g, or t
  misc_feature (24)..(24): n is a, c, g, or t
  misc_feature (26)..(26): n is a, c, g, or t
  misc_feature (45)..(45): n is a, c, g, or t
  misc_feature (51)..(51): n is a, c, g, or t
  misc_feature (58)..(58): n is a, c, g, or t
  misc_feature (65)..(65): n is a, c, g, or t
  misc_feature (490)..(490): n is a, c, g, or t
  misc_feature (573)..(573): n is a, c, g, or t
  misc_feature (589)..(589): n is a, c, g, or t
  misc_feature (603)..(603): n is a, c, g, or t
  misc_feature (645)..(646): n is a, c, g, or t
  misc_feature (705)..(705): n is a, c, g, or t
  misc_feature (707)..(707): n is a, c, g, or t
tntttancccnccaantatccagnanccacctgcccccaaccaanaaaaanaaaaagnagccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccacctctcttcgggcgactatcacctcaaggattgtgccaaaggcaaagtctgggtctcagatatcacctcaggcctcgtacaaggtggcggtgcttggtgctgacggtggcatcggtcaaccactgggcctgctgatcaagatgtctcctctggtctcagagctgcgcctgtatgatattgacaatgtcaagggagtcgctgcagatctcagncactgcaacacgccttctcaggtcatggacttcactggcccagcagaactagctgactgcttgaaaggtgttgatgttgtcgncatccctgcgggtgtnccaaggaagccagncatgacccgtgatgacctttttaacatcaatgcgggcatcgnnaagtcgcttattgaggctgttgcagacaactcccctgaggccttcatccatatcatcancnaccc

SEQ ID NO: 118 - DNA, 647 bp, Lolium perenne
  misc_feature (2)..(2): n is a, c, g, or t
  misc_feature (15)..(15): n is a, c, g, or t
  misc_feature (21)..(21): n is a, c, g, or t
  misc_feature (27)..(28): n is a, c, g, or t
  misc_feature (34)..(34): n is a, c, g, or t
gngcccccacccaanaaaaanaaaaannaccagnagcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgcc

SEQ ID NO: 119 - DNA, 801 bp, Lolium perenne
  misc_feature (2)..(2): n is a, c, g, or t
  misc_feature (34)..(35): n is a, c, g, or t
  misc_feature (760)..(760): n is a, c, g, or t
  misc_feature (800)..(800): n is a, c, g, or t
gncccccaaccaagaaaaaagaaaagcagccagnncgcaaggggcgagcccgggcgcacgagcaattcccatctgctcaccaacccaagttggacatggcatcagctgttaccatcagttcggtcagcgcgcagtccgctctggtttcgaaaccaaggaatcatggcagcacgagcttcggtggcctaaaggcatcatcggcgtcgatcagctttgaatcagggacatcgttcctgggcaagactgcctccctccgggcgactgttaccccaaggattgtgccaaaggcaaagtctgggtctcagatatcgcctcaggcatcttacaaggtggcggtgcttggtgctgctggtggcatcggccaaccactgggcctgctgatcaagatgtctcctctagtctcagagctgcgcctgtatgatattgccaatgtcaagggcgtcgctgcagatcttagccactgcaacacgccttctcaggtcatggacttcactggccccgcggaactagccgactgcttgaaaggtgtggatgttgtcgtcatccctgcgggtgtcccaaggaagcctggcatgactcgtgatgacctttttaacatcaatgcgggcatcgtcaagtcgcttatcgaggctgttgcagacaactgccctgaggccttcatccatatcatcagcaacccggtcaactccacggtgccgattgctgctgagattctgaaacagaagggcgtctacaaccccaagaagctcttcggggtttncaccctggatgttgtcagagctaacacatttgtagctcana

SEQ ID NO: 120 - DNA, 692 bp, Lolium perenne
  misc_feature (2)..(2): n is a, c, g, or t
  misc_feature (9)..(9): n is a, c, g, or t
  misc_feature (14)..(14): n is a, c, g, or t
  misc_feature (19)..(20): n is a, c, g, or t
  misc_feature (26)..(27): n is a, c, g, or t
  misc_feature (33)..(33): n is a, c, g, or t
  misc_feature (632)..(632): n is a, c, g, or t
  misc_feature (686)..(686): n is a, c, g, or t
gncccccanccaanaaaannaaaaannaccagnagcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtctcaaggaagccaggcatgacccgtgatgacctttttaacatcaatgcgggcatcgtcaagtcgcttattgaggctgntgcagacaactgccctgaggccttcatccatatcatcagcaacccggtcaactncactgt

SEQ ID NO: 121 - DNA, 695 bp, Lolium perenne
  misc_feature (8)..(9): n is a, c, g, or t
  misc_feature (20)..(20): n is a, c, g, or t
  misc_feature (26)..(27): n is a, c, g, or t
  misc_feature (29)..(29): n is a, c, g, or t
  misc_feature (34)..(34): n is a, c, g, or t
  misc_feature (687)..(687): n is a, c, g, or t
gcccccannccaacaaaaanaaaaannanccagnagcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcacgacccgtgatgacctttttaacatcaatgcgggcatcgtcaagtcgcttattgaggctgttgcagacaactgccctgaggccttcatccatatcatcagcaacccggtcaactncactgtga

SEQ ID NO: 122 - DNA, 403 bp, Lolium perenne
  misc_feature (4)..(4): n is a, c, g, or t
  misc_feature (10)..(10): n is a, c, g, or t
  misc_feature (32)..(33): n is a, c, g, or t
  misc_feature (278)..(278): n is a, c, g, or t
  misc_feature (303)..(303): n is a, c, g, or t
  misc_feature (329)..(329): n is a, c, g, or t
  misc_feature (384)..(384): n is a, c, g, or t
  misc_feature (403)..(403): n is a, c, g, or t
gccncaaccnagaaaaaagaaaagcagccagnncgcaaggggcgagcccgggcgcacgagcaattcccatctgctcaccaacccaagttggacatggcatcagctgttaccatcagttcggtcagcgcgcagtccgctctggtttcgaaaccaaggaatcatggcagcacgagcttcggtggcctaaaggcatcatcggcgtcgatcagctttgaatcagggacatcgttcctgggcaagactgcctccctccgggcgactgttaccccaaggattgngccaaaggcaaagtctgggtctcanatatcgcctcaggcatcttacaaggnggcggtgcttggtgctgctggtggcatcggtcaaccactgggcctgctgatcaanatgtctcctctggtctcan

SEQ ID NO: 123 - DNA, 561 bp, Lolium perenne
  misc_feature (6)..(6): n is a, c, g, or t
  misc_feature (11)..(11): n is a, c, g, or t
  misc_feature (19)..(19): n is a, c, g, or t
  misc_feature (23)..(23): n is a, c, g, or t
  misc_feature (31)..(31): n is a, c, g, or t
  misc_feature (43)..(43): n is a, c, g, or t
  misc_feature (534)..(534): n is a, c, g, or t
  misc_feature (536)..(536): n is a, c, g, or t
  misc_feature (549)..(550): n is a, c, g, or t
  misc_feature (554)..(554): n is a, c, g, or t
gtttcncaganaaaaaccnaaantatccagnagcaggggcganccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactggaacacgccttctcaggtcatggacttgactggcccagcagaactagctgactgcttgaaaggtgctgatgttgncngcatccctgcggnngtcncaaggaa

SEQ ID NO: 124 - DNA, 659 bp, Lolium perenne
  misc_feature (6)..(6): n is a, c, g, or t
  misc_feature (11)..(11): n is a, c, g, or t
  misc_feature (19)..(19): n is a, c, g, or t
  misc_feature (24)..(26): n is a, c, g, or t
  misc_feature (31)..(31): n is a, c, g, or t
gtttcncaganaaaaaccnaaagnnnccagnacgcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagcctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactcccctgaggccttcatc

SEQ ID NO: 125 - DNA, 706 bp, Lolium perenne
  misc_feature (2)..(3): n is a, c, g, or t
  misc_feature (9)..(9): n is a, c, g, or t
  misc_feature (11)..(12): n is a, c, g, or t
  misc_feature (24)..(25): n is a, c, g, or t
  misc_feature (31)..(31): n is a, c, g, or t
  misc_feature (685)..(685): n is a, c, g, or t
gnnacacanannaaaaacaaaaannaccagnagcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctggctgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactncactgtgccgattgctgctga

SEQ ID NO: 126 - DNA, 706 bp, Lolium perenne
  misc_feature (9)..(9): n is a, c, g, or t
  misc_feature (11)..(12): n is a, c, g, or t
  misc_feature (24)..(25): n is a, c, g, or t
  misc_feature (31)..(31): n is a, c, g, or t
gttacacanannaaaaacaaaaannaccagnagcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgaa

SEQ ID NO: 127 - DNA, 802 bp, Lolium perenne
  misc_feature (11)..(11): n is a, c, g, or t
  misc_feature (30)..(30): n is a, c, g, or t
  misc_feature (89)..(89): n is a, c, g, or t
  misc_feature (242)..(242): n is a, c, g, or t
  misc_feature (726)..(726): n is a, c, g, or t
  misc_feature (798)..(798): n is a, c, g, or t
  misc_feature (801)..(801): n is a, c, g, or t
cctcaaccaanaaaagaaaagcagctcagncgcaaggggcgagcccgggcgcacgagcaattcccatctgctcaccaacccaagttggncatggcatcagctgttaccatcagttcggtcagcgcgcagtccgctctggtttcgaaaccaaggaatcatggcagcacgagcttcggtggcctaaaggcatcatcggcgtcgatcagctttgaatcagggacatcgttcctgggcaagactgnctccctccgggcgactgttaccccaaggattgtgccaaaggcaaagtctgggtctcagatatcgcctcaggcatcttacaaggtggcggtgcttggtgctgctggtggcatcggtcaaccactgggcctgctgatcaagatgtctcctctggtctcagagctgcgcctgtatgatattgccaatgtcaagggcgtcgctgcagatcttagccactgcaacacgccttctcaggtcatggacttcactggccccgcggaactagccgactgcttgaaaggtgtggatgttgtcgtcatccctgcgggtgtcccaaggaagcctggcatgactcgtgatgacctttttaacatcaatgcgggcatcgtcaagtcgcttatcgaggctgttgcagacaactgccctgaggccttcatccatatcatcagcaacccggtcaactccacggtgccgattgctgctgagattctgaaacagaagggcgtntacaaccccaagaagctcttcggggtttccaccctggatgttgtcagagctaacacatttgtagctcaaaanaana

SEQ ID NO: 128 - DNA, 691 bp, Lolium perenne
  misc_feature (8)..(8): n is a, c, g, or t
  misc_feature (10)..(10): n is a, c, g, or t
  misc_feature (14)..(14): n is a, c, g, or t
  misc_feature (19)..(19): n is a, c, g, or t
  misc_feature (24)..(25): n is a, c, g, or t
  misc_feature (31)..(32): n is a, c, g, or t
  misc_feature (658)..(658): n is a, c, g, or t
  misc_feature (684)..(684): n is a, c, g, or t
tttcccananaacnaaaantttannaccagnngcaggggcgagccggggcgcacgcagcaattcccatctgctcaccaacccaagttgggcatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatncatatcatcagcaacccggtcaactncactgtg

SEQ ID NO: 129 - DNA, 705 bp, Lolium perenne
  misc_feature (11)..(11): n is a, c, g, or t
  misc_feature (17)..(17): n is a, c, g, or t
  misc_feature (24)..(24): n is a, c, g, or t
  misc_feature (30)..(30): n is a, c, g, or t
  misc_feature (36)..(36): n is a, c, g, or t
  misc_feature (217)..(217): n is a, c, g, or t
  misc_feature (629)..(629): n is a, c, g, or t
  misc_feature (683)..(683): n is a, c, g, or t
ttccccaaaancaaaanttttagnaccagnagcagnggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcanggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtctcaaggaagccaggcatgacccgtgatgacctttttaacatcaatgcgggcatcgtcaagtcgcttattgaggctgntgcagacaactgccctgaggccttcatccatatcatcagcaacccggtcaactncactgtgccgattgctgctgag

SEQ ID NO: 130 - DNA, 680 bp, Lolium perenne
  misc_feature (6)..(6): n is a, c, g, or t
  misc_feature (8)..(9): n is a, c, g, or t
  misc_feature (15)..(15): n is a, c, g, or t
  misc_feature (21)..(22): n is a, c, g, or t
  misc_feature (28)..(28): n is a, c, g, or t
  misc_feature (656)..(656): n is a, c, g, or t
  misc_feature (680)..(680): n is a, c, g, or t
acacanannaaaaanaaaaannaccagnacgcaggggcgagccggggcgcacgcagcaattcccatctgctcaccaacccaagttggagatggcatcagctgttaccatcagttcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatncatatcatcagcaacccggtcacn

SEQ ID NO: 131 - DNA, 705 bp, Lolium perenne
  misc_feature (6)..(6): n is a, c, g, or t
  misc_feature (8)..(9): n is a, c, g, or t
  misc_feature (15)..(15): n is a, c, g, or t
  misc_feature (21)..(22): n is a, c, g, or t
  misc_feature (28)..(28): n is a, c, g, or t
acacanannaaaaanaaaaannaccagnagcaggggcgagccggggcgcacgcagcaattcccgtctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagat

SEQ ID NO: 132 - DNA, 706 bp, Lolium perenne
  misc_feature (6)..(8): n is a, c, g, or t
  misc_feature (13)..(13): n is a, c, g, or t
  misc_feature (21)..(21): n is a, c, g, or t
  misc_feature (27)..(27): n is a, c, g, or t
  misc_feature (627)..(627): n is a, c, g, or t
  misc_feature (681)..(681): n is a, c, g, or t
acacannnaaaancaaaaagnaccagnagcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgntgcagacaactgccctgaggccttcatccatatcatcagcaacccggtcaactncactgtgccgattgctgctgagata

SEQ ID NO: 133 - DNA, 634 bp, Lolium perenne
  misc_feature (3)..(6): n is a, c, g, or t
  misc_feature (19)..(21): n is a, c, g, or t
  misc_feature (26)..(27): n is a, c, g, or t
  misc_feature (87)..(87): n is a, c, g, or t
cannnnaaaaacaaaaagnnnccagnngcaaggggcgagccggggcgcacgcagcaattcccatctgctcaccaacccaagttgggnatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagaca

SEQ ID NO: 134 - DNA, 758 bp, Lolium perenne
  misc_feature (13)..(13): n is a, c, g, or t
  misc_feature (28)..(28): n is a, c, g, or t
gttccaagaaaangaaaaaagagccagncgcaaggggcgagccggggcgcacgcagcaattcccatctgctcaccaacccaagttggagatggcatcagctgttaccatcagctcagtcagcgcgcaggccgccttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccacc

SEQ ID NO: 135 - DNA, 761 bp, Lolium perenne
  misc_feature (2)..(2): n is a, c, g, or t
  misc_feature (27)..(27): n is a, c, g, or t
  misc_feature (607)..(607): n is a, c, g, or t
  misc_feature (628)..(628): n is a, c, g, or t
  misc_feature (676)..(676): n is a, c, g, or t
  misc_feature (688)..(688): n is a, c, g, or t
  misc_feature (704)..(704): n is a, c, g, or t
  misc_feature (716)..(716): n is a, c, g, or t
  misc_feature (724)..(725): n is a, c, g, or t
  misc_feature (737)..(737): n is a, c, g, or t
  misc_feature (746)..(746): n is a, c, g, or t
  misc_feature (751)..(751): n is a, c, g, or t
  misc_feature (754)..(754): n is a, c, g, or t
gnaccagaaaaagaaaaaagagccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagctgaactagctgactgcttgaaaggtgttgatgttgtcgtcatccctgcgggtgtcccaaggaagccaggcatgacccgtgatgacctttttaacatcaatgcgggcatcgncaagtcgcttattgaggctgntgcagacaactgccctgaggccttcatccatatcatcagcaacccggncaactccactgngccgattgctgctganattctgaaacanaagggcgnntacaaccccaanaagctcttnggggnttncaccctg

SEQ ID NO: 136 - DNA, 772 bp, Lolium perenne
  misc_feature (2)..(2): n is a, c, g, or t
  misc_feature (27)..(28): n is a, c, g, or t
gnaccagaaaaagaaaaaagagccagnncgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcaa

SEQ ID NO: 137 - DNA, 772 bp, Lolium perenne
  misc_feature (2)..(2): n is a, c, g, or t
  misc_feature (27)..(28): n is a, c, g, or t
  misc_feature (772)..(772): n is a, c, g, or t
gnaccagaaaaagaaaaaagagccagnncgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcan

SEQ ID NO: 138 - DNA, 807 bp, Lolium perenne
  misc_feature (2)..(2): n is a, c, g, or t
  misc_feature (27)..(28): n is a, c, g, or t
  misc_feature (794)..(794): n is a, c, g, or t
gnaccagaaaaagaaaaaagagccagnncgcaaggggcgagccggggcgcacgcagcaattcccatctgctcaccaacccaagttggagatggcatcagctgttaccatcagctcagtcagcgcgcaggccgccttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcagagctaacacatttgtagctcanaagaagaacctca

SEQ ID NO: 139 - DNA, 628 bp, Lolium perenne
  misc_feature (3)..(3): n is a, c, g, or t
  misc_feature (5)..(6): n is a, c, g, or t
  misc_feature (12)..(12): n is a, c, g, or t
  misc_feature (18)..(19): n is a, c, g, or t
  misc_feature (26)..(27): n is a, c, g, or t
canannaaaaanaaaaannacccagnngcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcaccatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccatgatgacctttttaacatcaatgcgggcatcgtcaagtcgcttattgaggctgttgc

SEQ ID NO: 140 - DNA, 640 bp, Lolium perenne
  misc_feature (3)..(3): n is a, c, g, or t
  misc_feature (5)..(6): n is a, c, g, or t
  misc_feature (12)..(12): n is a, c, g, or t
  misc_feature (18)..(19): n is a, c, g, or t
  misc_feature (26)..(27): n is a, c, g, or t
canannaaaaanaaaaannacccagnngcaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccgctgcaacacgccttctcaggtcatggacttcactggcccagcagaactagctgactgcttgagaggtgttgatgttgtcgtcatccctgcgggtgtcccaaggaagccaggcatgacccgtgatgacctttttaacatcaatgcgggcatcgtcaagtcgcttattgaggctgttgcagacaactgccc

SEQ ID NO: 141 - DNA, 698 bp, Lolium perenne
  misc_feature (3)..(3): n is a, c, g, or t
  misc_feature (5)..(6): n is a, c, g, or t
  misc_feature (18)..(19): n is a, c, g, or t
  misc_feature (25)..(25): n is a, c, g, or t
canannaaaaacaaaaannaccagnagcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgtttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgct

SEQ ID NO: 142 - DNA, 713 bp, Lolium perenne
  misc_feature (3)..(3): n is a, c, g, or t
  misc_feature (5)..(6): n is a, c, g, or t
  misc_feature (18)..(19): n is a, c, g, or t
  misc_feature (21)..(21): n is a, c, g, or t
  misc_feature (26)..(26): n is a, c, g, or t
  misc_feature (627)..(627): n is a, c, g, or t
  misc_feature (655)..(655): n is a, c, g, or t
  misc_feature (681)..(681): n is a, c, g, or t
  misc_feature (713)..(713): n is a, c, g, or t
canannaaaaacaaaaannanccagnacgcaaggggcgagccggggcgcacgcagcaattcccatctgctcaccaacccaagttggagatggcatcagctgttaccatcagctcagtcagcgcgcaggccgctttgatctcgaaaccaaggaatcctggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgntgcagacaactgccctgaggccttcatncatatcatcagcaacccggtcaactncactgtgccgattgctgctgagattctgaaan

SEQ ID NO: 143 - DNA, 771 bp, Lolium perenne
  misc_feature (26)..(26): n is a, c, g, or t
gaccagaaaaagaaaaaagagccagncgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgaccaagatgtctcctctggtctcagagctgcgcctgtatgatattgccaatgtcaagggagtcgctgcaggtctcagccactgcaacacgccttctcaggtcatggacttcactggtccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcaga

SEQ ID NO: 144 - DNA, 773 bp, Lolium perenne
  misc_feature (26)..(27): n is a, c, g, or t
gtccagaaaaagaaaaaagagccagnncgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcagag

SEQ ID NO: 145 - DNA, 684 bp, Lolium perenne
  misc_feature (2)..(3): n is a, c, g, or t
  misc_feature (9)..(9): n is a, c, g, or t
  misc_feature (16)..(17): n is a, c, g, or t
  misc_feature (22)..(22): n is a, c, g, or t
  misc_feature (545)..(545): n is a, c, g, or t
annaaaagnaaaaagnncccgncgcaaggggcgagccggggcgcacgcagcaattcccatctgctcaccaacccaagttggggatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagaactgcgcctgtatgatattgccaatgtcaagggagtcgctgcagatctcagccactgcaacacgccttctcaggtcatggacttcgctggcccagcagaactagctgactgcttgaaaggtgttgatgttgtcgtcatccctgcgggtgtnccaaggaagccaggcatgacccgtgatgacctttttaacatcaatgcgggcatcgtcaagtcgcttattgaggctgttgcagacaactgccctgaggccttcatccatatcatcagcaacccggtcaacttcactgtgc

SEQ ID NO: 146 - DNA, 695 bp, Lolium perenne
  misc_feature (2)..(2): n is a, c, g, or t
  misc_feature (4)..(5): n is a, c, g, or t
  misc_feature (10)..(10): n is a, c, g, or t
  misc_feature (17)..(18): n is a, c, g, or t
  misc_feature (20)..(20): n is a, c, g, or t
  misc_feature (25)..(25): n is a, c, g, or t
  misc_feature (680)..(680): n is a, c, g, or t
anannaaaancaaaaannanccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactncactgtgccgattgt

SEQ ID NO: 147 - DNA, 695 bp, Lolium perenne
  misc_feature (3)..(4): n is a, c, g, or t
  misc_feature (9)..(10): n is a, c, g, or t
  misc_feature (16)..(17): n is a, c, g, or t
  misc_feature (23)..(23): n is a, c, g, or t
  misc_feature (624)..(624): n is a, c, g, or t
  misc_feature (678)..(678): n is a, c, g, or t
aannaaaannaaaaannaccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgntgcagacaactgccctgaggccttcatccatatcatcagcaacccggtcaactncactgtgccgattgctg

SEQ ID NO: 148 - DNA, 637 bp, Lolium perenne
  misc_feature (1)..(3): n is a, c, g, or t
  misc_feature (9)..(9): n is a, c, g, or t
  misc_feature (15)..(16): n is a, c, g, or t
  misc_feature (18)..(18): n is a, c, g, or t
  misc_feature (23)..(23): n is a, c, g, or t
nnnaaaaanaaaaannanccagnagcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgcc

SEQ ID NO: 149 - DNA, 675 bp, Lolium perenne
  misc_feature (2)..(3): n is a, c, g, or t
  misc_feature (8)..(8): n is a, c, g, or t
  misc_feature (15)..(16): n is a, c, g, or t
  misc_feature (22)..(22): n is a, c, g, or t
  misc_feature (623)..(623): n is a, c, g, or t
annaaaancaaaaannaccagnacgcaaggggcgagccggggcgcacgcagcaattcccatctgctcaccaacccaagttggagatggcatcagctgttaccatcagctcaatcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgntgcagacaactgccctgaggccttcatccatatcatcagcaacccggtcaac

SEQ ID NO: 150 - DNA, 764 bp, Lolium perenne
  misc_feature (1)..(1): n is a, c, g, or t
  misc_feature (720)..(720): n is a, c, g, or t
  misc_feature (741)..(741): n is a, c, g, or t
  misc_feature (745)..(745): n is a, c, g, or t
nagaaaaacaaaaaagagccagacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaacggcgtntccaccccaagaagcttttcngggnttacaccctggatgttgcc

SEQ ID NO: 151 - DNA, 785 bp, Lolium perenne
  misc_feature (393)..(393): n is a, c, g, or t
  misc_feature (745)..(745): n is a, c, g, or t
cagaaaaaagaaaagcagccagacgcaaggggcgagcccgggcgcacgagcaattcccatctgctcaccaacccaagttggacatggcatcagctgttaccatcagttcggtcagcgcgcagtccgctctggtttcgaaaccaaggaatcatggcagcacgagcttcggtggcctaaaggcatcatcggcgtcgatcagctttgaatcagggacatcgttcctgggcaagactgcctccctccgggcgactgttaccccaaggattgtgccaaaggcaaagtctgggtctcagatatcgcctcaggcatcttacaaggtggcggtgcttggtgctgctggtggcatcggtcaaccactgggcctgctgatcaagatgtctcctctggtctcanagctgcgcctgtatgatattgccaatgtcaagggcgtcgctgcagatcttagccactgcaacacgccttctcaggtcatggacttcactggccccgcggaactagccgactgcttgaaaggtgtggatgttgtcgtcatccctgcgggtgtcccaaggaagcctggcatgactcgtgatgacctttttaacatcaatgcgggcatcgtcaagtcgcttatcgaggctgttgcagacaactgccctgaggccttcatccatatcatcagcaacccggtcaactccacggtgccgattgctgctgagattctgaaacagaagggcgtctacaaccccaagaagctcttcggggnttccaccctggatgttgtcagagctaacacatttgtagct

SEQ ID NO: 152 - DNA, 706 bp, Lolium perenne
  misc_feature (2)..(2): n is a, c, g, or t
  misc_feature (7)..(7): n is a, c, g, or t
  misc_feature (14)..(15): n is a, c, g, or t
  misc_feature (21)..(21): n is a, c, g, or t
  misc_feature (676)..(676): n is a, c, g, or t
anaaaancaaaaannaccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactncactgtgccgattgctgctgagattctgaa

SEQ ID NO: 153 - DNA, 682 bp, Lolium perenne
  misc_feature (1)..(1): n is a, c, g, or t
  misc_feature (6)..(8): n is a, c, g, or t
  misc_feature (21)..(21): n is a, c, g, or t
  misc_feature (538)..(538): n is a, c, g, or t
  misc_feature (597)..(598): n is a, c, g, or t
  misc_feature (649)..(650): n is a, c, g, or t
  misc_feature (679)..(679): n is a, c, g, or t
naacannnaaaaacaaaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccaccgcaacacgcctgctcaggtcatggacttcactggccccgcggaactagcagagtgcttgaaaggcgtggatgttgtcgtcatccctgcgggtgtnccaaggaagccaggcatgacccgtgatgacctttttaacatcaatgcggcatcgtcagnngcttatcgaggctgttgcagacactgcctgaggccttatccatattatcannacccgggactgcacggtgccgattgctgnaat

SEQ ID NO: 154 - DNA, 712 bp, Lolium perenne
  misc_feature (2)..(2): n is a, c, g, or t
  misc_feature (8)..(8): n is a, c, g, or t
  misc_feature (10)..(11): n is a, c, g, or t
  misc_feature (16)..(16): n is a, c, g, or t
  misc_feature (525)..(525): n is a, c, g, or t
  misc_feature (575)..(575): n is a, c, g, or t
  misc_feature (596)..(596): n is a, c, g, or t
  misc_feature (601)..(601): n is a, c, g, or t
  misc_feature (638)..(638): n is a, c, g, or t
  misc_feature (665)..(665): n is a, c, g, or t
  misc_feature (686)..(686): n is a, c, g, or t
gnacacanannaaaancaaaaaaggggcgagccggggcgcacacagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggcctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgnatccctgcgggtgttccaaggaagccaggcatgacccgtgatgacctttntaacatcaatgcgggcatcgncaagncgcttatcgaggctgttgcagacaactgccctgaggncttgatccatattatgagaaccccggncaactccacggcgccgattgntgcagagattctgaaacagaaggcgt

SEQ ID NO: 155 - DNA, 644 bp, Lolium perenne
  misc_feature (11)..(12): n is a, c, g, or t
  misc_feature (19)..(19): n is a, c, g, or t
  misc_feature (619)..(619): n is a, c, g, or t
aaaccaaaaannacccagnagccaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaagggttgatgttgtcgtcatccctgcgggtgtcccaaggaagccaggcatgacccgtgatgacctttttaacatcaatgcgggcatcgtcaagtcgcttattgaggctgntgcagacaactgccctgaggccttt

SEQ ID NO: 156 - DNA, 683 bp, Lolium perenne
  misc_feature (2)..(2): n is a, c, g, or t
  misc_feature (7)..(7): n is a, c, g, or t
  misc_feature (9)..(10): n is a, c, g, or t
  misc_feature (23)..(23): n is a, c, g, or t
  misc_feature (671)..(671): n is a, c, g, or t
gncacanannaaaaacaaaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactncacggtgccgat

SEQ ID NO: 157 - DNA, 695 bp, Lolium perenne
  misc_feature (3)..(3): n is a, c, g, or t
  misc_feature (8)..(8): n is a, c, g, or t
  misc_feature (10)..(11): n is a, c, g, or t
  misc_feature (17)..(17): n is a, c, g, or t
  misc_feature (24)..(24): n is a, c, g, or t
  misc_feature (550)..(550): n is a, c, g, or t
gancccanannaaaaanaaaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctctggtcatggacttcactggccccgcggaactagcagagtgcttgaaaggcgtggatgttgtcgtcatccctgcgggtgtcccaaggaanccaggcatgacccgtgatgacctttttaacatcaatgcgggcatcgtcaagtcgcttatcgaggctgttgcagacaactgccctgaggccttcatccatattatcagcaacccggtcaactccacggtgccgattgctgcagaga

SEQ ID NO: 158 - DNA, 802 bp, Lolium perenne
  misc_feature (12)..(12): n is a, c, g, or t
  misc_feature (89)..(89): n is a, c, g, or t
  misc_feature (740)..(740): n is a, c, g, or t
  misc_feature (773)..(773): n is a, c, g, or t
  misc_feature (780)..(780): n is a, c, g, or t
  misc_feature (783)..(783): n is a, c, g, or t
gaccagaaaaangaaaaaaggggcgagccggggcgcacgcagcaattcccatctgcccaccaacccaagttggacatggcatcagctgncaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggtggtgcttggtgctgctggtggcatcggtcaaccactgggcctgctgatcaagatgtctcctctggtctcagagctgcgcctgtatgatattgccaatgtcaagggcgtcgctgcagatcttagccactgcaacacgccttctcaggtcatggacttcactggccccgcggaactagccgactgcttgaaaggtgtggatgttgtcgtcatccctgcgggtgtcccaaggaagcctggcatgactcgtgatgacctttttaacatcaatgcgggcatcgtcaagtcgcttatcgaggctgttgcagacaactgccctgaggccttcatccatatcatcagcaacccggtcaactccacggtgccgattgctgctgagattctgaaacagaagggcgtctacaaccccaagaagctcttcggggtttncaccctggatgttgtcagagctaacacatttgnagctcanaanaagaacctcagtcttatcg

SEQ ID NO: 159 - DNA, 637 bp, Lolium perenne
  misc_feature (4)..(4): n is a, c, g, or t
  misc_feature (10)..(11): n is a, c, g, or t
  misc_feature (18)..(19): n is a, c, g, or t
aaanaaaaannacccagnngcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccagacaactgccctgaggccttcatccatatcatcagcaacccggtcaactccactgtgccgattgctgctgagatctaaacagaa

SEQ ID NO: 160 - DNA, 686 bp, Lolium perenne
  misc_feature (3)..(3): n is a, c, g, or t
  misc_feature (11)..(12): n is a, c, g, or t
  misc_feature (18)..(18): n is a, c, g, or t
  misc_feature (673)..(673): n is a, c, g, or t
aanccaaaaannaccagnacgcagggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactncactgtgccgatt

SEQ ID NO: 161 - DNA, 693 bp, Lolium perenne
  misc_feature (11)..(11): n is a, c, g, or t
  misc_feature (17)..(17): n is a, c, g, or t
  misc_feature (672)..(672): n is a, c, g, or t
aaacaaaaaanaccagnacgcaaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatgggcttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactncactgtgccgattgctgctgc

SEQ ID NO: 162 - DNA, 647 bp, Lolium perenne
  misc_feature (6)..(6): n is a, c, g, or t
  misc_feature (8)..(9): n is a, c, g, or t
  misc_feature (15)..(15): n is a, c, g, or t
  misc_feature (17)..(17): n is a, c, g, or t
cacaanannaaaaananaaaaggggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccat

SEQ ID NO: 163 - DNA, 661 bp, Lolium perenne
  misc_feature (3)..(4): n is a, c, g, or t
  misc_feature (10)..(11): n is a, c, g, or t
  misc_feature (17)..(17): n is a, c, g, or t
aannaaaaannaccagnacgcagggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaac

SEQ ID NO: 164 - DNA, 640 bp, Lolium perenne
  misc_feature (2)..(4): n is a, c, g, or t
  misc_feature (7)..(7): n is a, c, g, or t
  misc_feature (13)..(13): n is a, c, g, or t
  misc_feature (18)..(18): n is a, c, g, or t
  misc_feature (20)..(20): n is a, c, g, or t
gnnnaanaaaaanaaaanangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgacctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttca

SEQ ID NO: 165 - DNA, 681 bp, Lolium perenne
  misc_feature (3)..(3): n is a, c, g, or t
  misc_feature (5)..(6): n is a, c, g, or t
  misc_feature (19)..(19): n is a, c, g, or t
canannaaaaacaaaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggttaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactccacggtgccgattg

SEQ ID NO: 166 - DNA, 741 bp, Lolium perenne
  misc_feature (2)..(2): n is a, c, g, or t
gnaccagaaaaagaaaaaaaggggcgagccggggcgcacgcagcaattcccatctgcccaccaacccaagttggacatggcatctgctgtcaccatcagttcagtcagcgcccaggccgctctggtgtcaaaaccaaggagtcatggcagcacgagcttcagtggcctgaaggcatcatcatcgtcgatcagcttcgaatctggagcatcattcctgggcaagactgcctctcttcgggcgtcagtcaccccgaggattgtgccaaaggcaaagtctgggtctcagatatcgcctcaggcatctcacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactccacggtgccgattgctgcagagattctgaaacagaagggcgtctacaaccccaagaagctcttcggggtttc

SEQ ID NO: 167 - DNA, 665 bp, Lolium perenne
  misc_feature (3)..(6): n is a, c, g, or t
  misc_feature (11)..(11): n is a, c, g, or t
  misc_feature (22)..(22): n is a, c, g, or t
  misc_feature (614)..(614): n is a, c, g, or t
  misc_feature (664)..(664): n is a, c, g, or t
cannnnaaaancaaaaaagggnacgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgntgcagacaactgccctgaggccttcatccatattatcagcaacccggtcna

SEQ ID NO: 168 - DNA, 680 bp, Lolium perenne
  misc_feature (3)..(3): n is a, c, g, or t
  misc_feature (5)..(6): n is a, c, g, or t
  misc_feature (12)..(12): n is a, c, g, or t
  misc_feature (14)..(14): n is a, c, g, or t
  misc_feature (19)..(19): n is a, c, g, or t
  misc_feature (667)..(667): n is a, c, g, or t
  misc_feature (680)..(680): n is a, c, g, or t
canannaaaaananaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagccaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactncacggtgccgatn

SEQ ID NO: 169 - DNA, 770 bp, Lolium perenne
gaccagaaaaagaaaaaaaggggcgagccggggcgcacgcagcaattcccatctgcccaccaacccaagttggacatggcatcagccgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactccacggtgccgattgctgcagagattctgaaacagaagggcgtctacaaccccaagaagctcttcggggtttccaccctggatgttgtcagggctaacacatt

SEQ ID NO: 170 - DNA, 702 bp, Lolium perenne
  misc_feature (2)..(2): n is a, c, g, or t
  misc_feature (4)..(5): n is a, c, g, or t
  misc_feature (11)..(11): n is a, c, g, or t
  misc_feature (18)..(18): n is a, c, g, or t
anannaaaaanaaaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactccacggtgccgattgctgcagagattctgaaacagag

SEQ ID NO: 171 - DNA, 777 bp, Lolium perenne
cagaaaaagaaaaaaaggggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactccacggtgccgattgctgcagagattctgaaacagaagggcgtctacaaccccaagaagctcttcggggtttcccccctggatgttgtcagggctaacacatttgtagctcaa

SEQ ID NO: 172 - DNA, 707 bp, Lolium perenne
  misc_feature (8)..(8): n is a, c, g, or t
  misc_feature (11)..(11): n is a, c, g, or t
  misc_feature (659)..(659): n is a, c, g, or t
aaaaaaanaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactncacggtgccgattgctgcagagattctgaaacaaaaggcgtctacaac

SEQ ID NO: 173 - DNA, 687 bp, Lolium perenne
  misc_feature (3)..(4): n is a, c, g, or t
  misc_feature (11)..(11): n is a, c, g, or t
  misc_feature (571)..(571): n is a, c, g, or t
  misc_feature (605)..(605): n is a, c, g, or t
  misc_feature (655)..(655): n is a, c, g, or t
  misc_feature (665)..(665): n is a, c, g, or t
  misc_feature (674)..(674): n is a, c, g, or t
  misc_feature (680)..(680): n is a, c, g, or t
aannaaaaaangggcgagccggggcgcacgcagcaattcccatctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcccgtatgataatgcgaatgtcaagggcgtcgctgccgatctcagccactgcaacacgcctgctcaggtcatggacttcactggccccgcggaactagcagagtgcttgaaaggcgtggatgctgtcgtcatccctgcgggtgtcccaaggaagccaggcatgacccgtgatgacctttttaacatcnatgcgggcatcgtcaagtcgcttatcgaggctgntgcagacaactgccctgaggccttcatccatattatcagcaacccggtcnactccacggngccgattgntgcaanattttgc

SEQ ID NO: 174 - DNA, 473 bp, Lolium perenne
  misc_feature (211)..(211): n is a, c, g, or t
  misc_feature (258)..(258): n is a, c, g, or t
  misc_feature (354)..(355): n is a, c, g, or t
  misc_feature (369)..(369): n is a, c, g, or t
  misc_feature (397)..(397): n is a, c, g, or t
  misc_feature (421)..(422): n is a, c, g, or t
  misc_feature (441)..(441): n is a, c, g, or t
  misc_feature (445)..(445): n is a, c, g, or t
  misc_feature (461)..(461): n is a, c, g, or t
  misc_feature (465)..(465): n is a, c, g, or t
  misc_feature (468)..(468): n is a, c, g, or t
caaggggcgagccggggcgcacgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggccatcattcctggacaagaccgnctctcttcgggcgactatcacctcaaggattgtgccaaaggcaaagnctgggtctcagatatcacctcaggcctcgtacaaggtggcggtgcttggtgctgccggtggcatcggtcaaccactgggcctgctgatcaagatgnntcctctggtctcanagctgcgcctgtatgatattgccaatgncaagggagtcgctgcaaatctcanncactgcaacacgccttctnaggncatggacttcactggnccancanaacta

SEQ ID NO: 175 - DNA, 642 bp, Lolium perenne
  misc_feature (2)..(2): n is a, c, g, or t
  misc_feature (9)..(10): n is a, c, g, or t
  misc_feature (38)..(38): n is a, c, g, or t
  misc_feature (478)..(478): n is a, c, g, or t
  misc_feature (641)..(641): n is a, c, g, or t
anaggggcnngccggggcgccgcgaattccatctgccnccaccaagttggacatggcatcagctgtaccatcagttagtagcgcccaggccgctctggtgtaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgctggtggcatcggtcaaccactgggcctgctgatcaagatgtctcctctggtctcagagctgcgcctgtatgatattgccaatgtcaagggcgtcgctgcagatcttagccactgcaacacgccttctcaggtcatggacttcactggccccgcggaactagccgactgcttgaaangtgtggatgttgtcgtcatccctgcgggtgtcccaaggaagcctggcatgactcgtgatgacctttttaacatcaatgcgggcatcgccaagtcgcttatcaaggctgttgcagacaactcccttgaggccttcatccatatcatcagcaacccggtcaactnc

SEQ ID NO: 176 - DNA, 767 bp, Lolium perenne
  misc_feature (12)..(12): n is a, c, g, or t
ggagccggggcnccgcagcaattcccatctgctcaccaacccaagttggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcacctcaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactccactgtgccgattgctgctgagattctgaaacagaagggcgtctacaaccccaagaagctcttcggggtttccaccctggatgttgtcagagctaacacatttgtagctcagaagaagaacct

SEQ ID NO: 177 - DNA, 701 bp, Lolium perenne
  misc_feature (637)..(637): n is a, c, g, or t
gggggcgcacgcacaattcccatctgctcaccaacccattggagatggcatcagctgttaccatcagctcagtcagcgcgcaggccgctttggtctcgaaaccaaggaatcatggcagcacaagctacagtggcctaaaggcatcatcatcgtcgatcagcttcgaatcagggacatcattcctgggcaagaccgcctctcttcgggcgactatcacctcaaggattgtgccaaaggcaaagtctgggtctcagatatcaccccaggcctcgtacaaggtggcggtgcttggtgctgccggtggcatcggtcaaccactgggcctgctgatcaagatgtctcctctggtctcagagctgcgcctgtatgatattgccaatgtcaagggagtcgctgcagatctcagccactgcaacacgccttctcaggtcatggacttcactggcccagcagaactagctgactgcttgaaaggtgttgatgttgtcgtcatccctgcgggtgtcccaaggaagccaggcatgacccgtgatgacctttttaacatcaatgcgggcatcgtcaagtcgcttattgaggctgttgcagacaactgccctgaggccttcatccatatcatcagcaacccggtcaactncactgtgccgattgctgctgagattctgaaacagaagggcgtctacagccccaagaagctctta

SEQ ID NO: 178 - DNA, 333 bp, Lolium perenne
  misc_feature (1)..(1): n is a, c, g, or t
  misc_feature (17)..(17): n is a, c, g, or t
  misc_feature (33)..(33): n is a, c, g, or t
  misc_feature (281)..(281): n is a, c, g, or t
  misc_feature (293)..(293): n is a, c, g, or t
  misc_feature (297)..(297): n is a, c, g, or t
  misc_feature (303)..(303): n is a, c, g, or t
  misc_feature (327)..(327): n is a, c, g, or t
ncagcagcaattccctnctgcccaccaacccanttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggngcttggtgctgncggnggcatnggccaaccactgggcctgctgatnaagatg

SEQ ID NO: 179 - DNA, 630 bp, Lolium perenne
  misc_feature (2)..(2): n is a, c, g, or t
  misc_feature (6)..(6): n is a, c, g, or t
  misc_feature (16)..(17): n is a, c, g, or t
  misc_feature (33)..(33): n is a, c, g, or t
gncacnacattccccnnctgcccaccaacccanttggaatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgtcgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaact

SEQ ID NO: 180 - DNA, 671 bp, Lolium perenne
  misc_feature (467)..(467): n is a, c, g, or t
  misc_feature (617)..(617): n is a, c, g, or t
tctgcccaccaacccaagttggacatggcatcagctgtcaccatcagttcagtcagcgcccaggccgctctggtgtcaaaaccaaggagtcatggcagcacgagcttcagtggcctgaaggcatcatcatcgtcgatcagcttcgaatctggaacatcattcctgggcaagactgcctctcttcgggcgtcagtcaccccgaggattgtgccaaaggcaaagtctgggtctcagatatcgcctcaggcatcttacaaggtggcggtgcttggtgctgccggtggcatcggtcaaccactgggcctgctgatcaagatgtcgcctctggtctcggagctgcgcctgtatgatattgcgaatgtcaagggcgtcgctgccgatctcagccactgcaacacgcctgctcaggtcatggacttcactggccccgcggaactagcagagtgcttgaaaggcgtggatgttgncgtcatccctgcgggtgtcccaaggaagccaggcatgacccgtgatgacctttttaacatcaatgcgggcatcgtcaagtcgcttatcgaggctgttgcagacaactgccctgaggccttcatccatattatcagcaacccggtcaactncacggtgccgattgctgcagagattctgaaacagaagggcgtctacaaccccaa

SEQ ID NO: 181 - DNA, 634 bp, Lolium perenne
ttggtgctgctggtggcatcggtcaaccactgggcctgctgatcaagatgtctcctctcgtctcggagctgcgcctgtatgatatcgccaatgtcaagggagtcgctgcagatctcagccactgcaacacgcctgctcaggccatggacttcactggccccgcggaactagcagagtgcttgaaaggtgtggatgttgtcgtcatccctgcgggtgtcccaaggaagcctggcatgactcgtgatgacctttttaacatcaatgcgggcatcgtcaagtcgcttattgaggctgttgcagacaactgcccagaggccttcatccatatcatcagcaacccggtcaactccactgtgccgattgctgctgagattctgaaacagaagggtgtctacaaccccaagaagctcttcggggtttccaccctggatgttgtcagagctaacacatttgtagctcagaagaagaacctcagcctcatcgatgttgatgtcccagttgtcggtggccatgctgggatcacgattctgcctctgttgtccaagactaggccttctgtcagcttcacggacgaggaaactgaacagctgacaaagaggatacagaacgctgggacagaggtggtggaggcgaa

SEQ ID NO: 182 - DNA, 777 bp, Lolium perenne
  misc_feature (693)..(693): n is a, c, g, or t
  misc_feature (756)..(756): n is a, c, g, or t
gatcagccctgcaacacgcctgctcaggccatggacttcactggccccgcggaactagcagagtgcttgaaaggtgtggatgttgtcgtcatccctgcgggtgtcccaaggaagcctggcatgactcgtgatgacctttttaacatcaatgcgggcatcgtcaagtcgcttattgaggctgttgcagacaactgcccagaggccttcatccatatcatcagcaacccggtcaactccactgtgccgattgctgctgagattctgaaacagaagggtgtctacaaccccaagaagctcttcggggtttccaccctggatgttgtcagagctaacacatttgtagctcagaagaagaacctcagcctcatcgatgttgatgtcccagttgtcggtggccatgctgggatcacgattctgcctctgttgtccaagactaggccttctgtcagcttcacggacgaggaaactgaacagctgacaaagaggatacagaacgctgggacagaggcggtggaggcgaaggctggtgctggctctgctactctgtccatggcttatgccgctgccagatttgttgagtcatcgctccgcgcaatggctggtgatccagatgtttacgagtgcacgtatgttcagtctgagttaacagagcttccattcttcgcgtccagagttaagcttgggaaggacggngttgagtccatcatttcctccgacctggagggagtgacggagtacgaggccaaggcgcttgangcattgaaggctgagctgaag

SEQ ID NO: 183 - DNA, 414 bp, Lolium perenne
  misc_feature (2)..(2): n is a, c, g, or t
  misc_feature (9)..(10): n is a, c, g, or t
  misc_feature (14)..(14): n is a, c, g, or t
  misc_feature (23)..(23): n is a, c, g, or t
  misc_feature (26)..(26): n is a, c, g, or t
  misc_feature (47)..(47): n is a, c, g, or t
  misc_feature (347)..(347): n is a, c, g, or t
  misc_feature (360)..(360): n is a, c, g, or t
  misc_feature (394)..(394): n is a, c, g, or t
  misc_feature (405)..(405): n is a, c, g, or t
  misc_feature (409)..(409): n is a, c, g, or t
gnaaacagnngcgncttttcctncantgttgccgtgcaatcgctganaagtatccagaaatcatatacgaggaagtaattattgataactgctgtatgacgctcgtgaagaaccctggtacgtttgatgtattagtgatgccaaatctatatggcgacattattagtgatctatgtgctggtttgatcggaggcttgggcctaactcccagctgcaacattggtgaaggtggcatttgtcttgcagaggctgtccatggctctgcacctgatatatctggcaagaacctggcaaacccaactgctcttatgctgagtgctgttatgatgttgcgccacttgcaattnaacgaccaagcanaacggatccacaatgctatcctccagactatcgncgaggggaagnacanaactg

SEQ ID NO: 184 - protein, 137 aa, Lolium perenne
  misc_feature (3)..(4): Xaa can be any naturally occurring amino acid
  misc_feature (7)..(8): Xaa can be any naturally occurring amino acid
  misc_feature (15)..(15): Xaa can be any naturally occurring amino acid
  misc_feature (115)..(115): Xaa can be any naturally occurring amino acid
  misc_feature (120)..(120): Xaa can be any naturally occurring amino acid
  misc_feature (131)..(131): Xaa can be any naturally occurring amino acid
  misc_feature (135)..(136): Xaa can be any naturally occurring amino acid
KQXXLFXXCCRAIAXKYPEIIYEEVIIDNCCMTLVKNPGTFDVLVMPNLYGDIISDLCAGLIGGLGLTPSCNIGEGGICLAEAVHGSAPDISGKNLANPTALMLSAVMMLRHLQXNDQAXRIHNAILQTIXEGKXXT

SEQ ID NO: 185 - DNA, 652 bp, Lolium perenne
  misc_feature (2)..(2): n is a, c, g, or t
  misc_feature (7)..(7): n is a, c, g, or t
  misc_feature (12)..(13): n is a, c, g, or t
  misc_feature (646)..(646): n is a, c, g, or t
gncaccnccagnnacaactctggtacctcaattgctactccacacctcactacttctaccaatccactacacagcttcgagctaccccgcccccgcaatccaaactacctctccctagcaaatctacaacatgaaggcagtcgtagctggagccgccggtggcattggacagccattgtccctcctccttaagacctgcccgctcgtcactgagctcgccctatacgatgtcgtcaacgccgtcggtgtcgcgactgacctctcccacatctcctcgcccgcgaaagtaaccggctacctgccggcaaatgacggtatgcagcaggctctcactggcgccgacatcgtggtcatccccgctggtattccccgcaagcccggcatgacccgtgacgacctcttcaagatcaacgccggcattgtccagggtctcatcgagggtgtcgccaagcactgccccaaggcatacgttctcgtcatctccaaccccgtcaactcgactgtgcccatcgccgccgaggtgctgaagaaggccggtgtcttcgaccccaagaagctcttcggtgtcaccaccctcgatgtcgtccgcgccgagaccttcgttgccgagatcactggcgagaaggacccagcgaagttgaacatncccgta

SEQ ID NO: 186 - protein, 216 aa, Lolium perenne
  misc_feature (1)..(2): Xaa can be any naturally occurring amino acid
  misc_feature (4)..(4): Xaa can be any naturally occurring amino acid
  misc_feature (214)..(214): Xaa can be any naturally occurring amino acid
XXPXTTLVPQLLLHTSLLLPIHYTASSYPAPAIQTTSPQIYNMKAVVAGAAGGIGQPLSLLLKTCPLVTELALYDVVNAVGVATDLSHISSPAKVTGYLPANDGMQQALTGADIVVIPAGIPRKPGMTRDDLFKINAGIVQGLIEGVAKHCPKAYVLVISNPVNSTVPIAAEVLKKAGVFDPKKLFGVTTLDVVRAETFVAEITGEKDPAKLNXPV

SEQ ID NO: 187 - DNA, 769 bp, Lolium perenne
  misc_feature (2)..(2): n is a, c, g, or t
  misc_feature (31)..(31): n is a, c, g, or t
  misc_feature (149)..(149): n is a, c, g, or t
  misc_feature (624)..(624): n is a, c, g, or t
  misc_feature (669)..(669): n is a, c, g, or t
gngtacacgaaatagaatcaacggaaagcangaagtgatgattgggtatcagcattctgggaaggatgctggccgtttctctgctggttggcacttgtacaaagctcaagaggagcttattaaggttgcggagacgtttggggttaagntgactatgtttcatggacgagggggtactgttggaagaggtggcggccctacccatcttgctatactgtcacaacctccagatactgtccatggatcacttcgggtaactgttcaaggtgaagtcattgagcagtccttcggagaggagcatttgtgttttagaacgcttcaacgttttacagctgctactcttgaacatggtatgcatccaccaatctcacctaaaccagaatggcgtgctttgatggatgaaatggctgttgttgccacagaggaataccgttccattgttttccaagaaccaagatttgttgagtatttccgccttgcaacaccagagctcgagtatggtaggatgaatattggaagcaggccatcaaaacgtaagccaagcggaggaatcgaatcattgcgtgcaattccttggatatttgcttggacacagactagattccacctgccagtgtggcttgnttttggtgcggccttcaagcatgtcctgcaaaaggacattcgtantcttcaaatccttcagcagatgtacaacgagtggccgtttagggttaccataaacctggttgagatggtgtttgccaagggcgatccaggtatagcagct

SEQ ID NO: 188 - protein, 256 aa, Lolium perenne
  misc_feature (1)..(1): Xaa can be any naturally occurring amino acid
  misc_feature (10)..(10): Xaa can be any naturally occurring amino acid
  misc_feature (50)..(50): Xaa can be any naturally occurring amino acid
  misc_feature (208)..(208): Xaa can be any naturally occurring amino acid
  misc_feature (223)..(223): Xaa can be any naturally occurring amino acid
XTRNRINGKXEVMIGYQHSGKDAGRFSAGWHLYKAQEELIKVAETFGVKXTMFHGRGGTVGRGGGPTHLAILSQPPDTVHGSLRVTVQGEVIEQSFGEEHLCFRTLQRFTAATLEHGMHPPISPKPEWRALMDEMAVVATEEYRSIVFQEPRFVEYFRLATPELEYGRMNIGSRPSKRKPSGGIESLRAIPWIFAWTQTRFHLPVWLXFGAAFKHVLQKDIRXLQILQQMYNEWPFRVTINLVEMVFAKGDPGIAA

SEQ ID NO: 189 - DNA, 1640 bp, Lolium perenne
  misc_feature (24)..(24): n is a, c, g, or t
  misc_feature (31)..(31): n is a, c, g, or t
  misc_feature (192)..(192): n is a, c, g, or t
  misc_feature (1194)..(1194): n is a, c, g, or t
  misc_feature (1514)..(1514): n is a, c, g, or t
  misc_feature (1530)..(1530): n is a, c, g, or t
  misc_feature (1584)..(1584): n is a, c, g, or t
  misc_feature (1616)..(1616): n is a, c, g, or t
  misc_feature (1622)..(1622): n is a, c, g, or t
  misc_feature (1633)..(1633): n is a, c, g, or t
gaagaagttgctgatgttttaagnacatttntgtccttgcagagctcccagcagattgttttggtgcttacatcatctcaatggcaactgccccatctgatgtgcttgctgttgagcttttgcagcgggagtgccatataaaaaagccattgagagttgttccactatttgaaaagcttgcagatcttgaancagctccagcatctgttgcacgactattttcaatagactggtacatgaatagaatcaatggcaagcaggaggtcatgattggatactcagactctgggaaggacgctgggcgtctctctgcagcgtggcaaatgtataaagcacaagaagatctcataaaggtggcaaagcaatatggagtaaagttaacaatgtttcatggaagaggtggaacggttggcagaggaggtggtcccagtcatcttgctatattatctcaaccaccagacacgatacaaggatcacttcgtgtaacagttcaaggcgaggtcatagagcactcatttggagaggaacacttgtgcttcagaactctgcaacgtttcactgcagctactcttgagcatggaatgcatcctccaatttcacccaagccagaatggcgtgctataatggatgagatggctgtagtggcaacaaaagaatatcgatcaattgtcttccaagaaccacgttttgtcgaatacttccgctcggcaacacctgagactgaatatggtcggatgaatattggtagccggccatcaaagagaaagcctagtggaggcatagaatcgctccgtgcaattccatggatctttgcttggacacagacaaggtttcatcttcctgtatggcttggatttggtgcagcgttcaaacatatcatgcagaaggacatcaggaatatccatactctgaaagaaatgtacaatgagtggccattctttagggtcacccttgacttgcttgagatggtttttgccaagggagatccaggaattgctgctttatatgacaaattgcttgtgtctgaagatctgcagccctttggggagcagctgagaaacaactttgaagagacgaaacagttactccttcaggttgctggccacaaggacgttcttgaaggggatccttacctgaagcagcgtctgcggttgcgtgagtcatacatcacaacattgaatgtttgccaagccnacaccctgaagcggataagagaccctagcttcgaggtgacaccgcagcaggcacctctgtcgaaggagttcgctgatgagaaggagccagctgagctggtgcaactgaaccgtgggagcgagtacgccccaggcctggaggacaccctcatccttaccatgaagggtatttgctgtggaatgcaaaacacaggctaggccagtttgcctatttggaataactgtcatcccgtcagatggggcgtgaatatgtgtgttccccaaatgctagtgaaccctggaggcattttggccacttacatgccttttggttatggatgnactttgatcttaatgncaagggttgttgaagcctgatctaaataaaatatggaacaatgatattctggtnggatctaataatttgcttggctctggcatcgnaatagngatttggagtngtttaac

SEQ ID NO: 190 - protein, 462 aa, Lolium perenne
  misc_feature (4)..(4): Xaa can be any naturally occurring amino acid
  misc_feature (8)..(8): Xaa can be any naturally occurring amino acid
  misc_feature (10)..(10): Xaa can be any naturally occurring amino acid
  misc_feature (64)..(64): Xaa can be any naturally occurring amino acid
  misc_feature (398)..(398): Xaa can be any naturally occurring amino acid
RSCXCFKXIXVLAELPADCFGAYIISMATAPSDVLAVELLQRECHIKKPLRVVPLFEKLADLEXAPASVARLFSIDWYMNRINGKQEVMIGYSDSGKDAGRLSAAWQMYKAQEDLIKVAKQYGVKLTMFHGRGGTVGRGGGPSHLAILSQPPDTIQGSLRVTVQGEVIEHSFGEEHLCFRTLQRFTAATLEHGMHPPISPKPEWRAIMDEMAVVATKEYRSIVFQEPRFVEYFRSATPETEYGRMNIGSRPSKRKPSGGIESLRAIPWIFAWTQTRFHLPVWLGFGAAFKHIMQKDIRNIHTLKEMYNEWPFFRVTLDLLEMVFAKGDPGIAALYDKLLVSEDLQPFGEQLRNNFEETKQLLLQVAGHKDVLEGDPYLKQRLRLRESYITTLNVCQAXTLKRIRDPSFEVTPQQAPLSKEFADEKEPAELVQLNRGSEYAPGLEDTLILTMKGICCGMQNTG

SEQ ID NO: 191 - DNA, 697 bp, Lolium perenne
  misc_feature (24)..(24): n is a, c, g, or t
  misc_feature (31)..(31): n is a, c, g, or t
  misc_feature (192)..(192): n is a, c, g, or t
  misc_feature (541)..(541): n is a, c, g, or t
  misc_feature (616)..(616): n is a, c, g, or t
  misc_feature (632)..(632): n is a, c, g, or t
  misc_feature (643)..(643): n is a, c, g, or t
  misc_feature (670)..(670): n is a, c, g, or t
  misc_feature (685)..(685): n is a, c, g, or t
  misc_feature (691)..(691): n is a, c, g, or t
  misc_feature (693)..(693): n is a, c, g, or t
gaagaagttgctgatgttttaagnacatttntgtccttgcagagctcccagcagattgttttggtgcttacatcatctcaatggcaactgccccatctgatgtgcttgctgttgagcttttgcagcgggagtgccatataaaaaagccattgagagttgttccactatttgaaaagcttgcagatcttgaancagctccagcatctgttgcacgactattttcaatagactggtacatgaatagaatcaatggcaagcaggaggtcatgattggatactcagactctgggaaggacgctgggcgtctctctgcagcgtggcaaatgtataaagcacaagaagatctcataaaggtggcaaagcaatatggagtaaagttaacaatgtttcatggaagaggtggaacggttggcagaggaggtggtcccagtcatcttgctatattatctcaaccaccagacacgatacaaggatcacttcgtgtaacagttcaaggcgaggtcatagagcactcatttggagaggaacacttgtgcttcanaactctgcaacgtttcactgcagctactcttgagcatggaatgcatcctccaatttcccccaaaccagaatggcntgctataatggatganatggctgtagnggcaccaaaagaaaatcgatcaattgncttccaagaaccccnttttgncnaata

SEQ ID NO: 192 - DNA, 785 bp, Lolium perenne
  misc_feature (732)..(732): n is a, c, g, or t
  misc_feature (758)..(758): n is a, c, g, or t
  misc_feature (777)..(777): n is a, c, g, or t
gtataaagcacaagaagatctcataaaggtggcaaagcaatatggagtaaagttaacaatgtttcatggaagaggtggaacggttggcagaggaggtggtcccagtcatcttgctatattatctcaaccaccagacacgatacaaggatcacttcgtgtaacagttcaaggcgaggtcatagagcactcatttggaggggaacacttgtgcttcagaactctgcaacgtttcactgcagctactcttgagcatggaatgcatcctccaatttcacccaagccagaatggcgtgctataatggatgagatggctgtagtggcaacaaaagaatatcgatcaattgtcttccaagaaccacgttttgtcgaatacttccgctcggcaacacctgagactgaatatggtcggatgaatattggtagccggccatcaaagagaaagcctagtggaggcatagaatcgctccgtgcaattccatggatctttgcttggacacagacaaggtttcatcttcctgtatggcttggatttggtgcagcgttcaaacatatcatgcagaaggacatcaggaatatccatactctgaaagaaatgtacaatgagtggccattctttagggtcacccttgacttgcttgagatggtttttgccaagggagatccaggaattgctgctttatatgacaaattgcttgtgtctgaagatctgcagccctttggggagcagctganaaacaactttgaagagacgaaacagntactctttaaggttgttgnccacaagg

SEQ ID NO: 193 - DNA, 783 bp, Lolium perenne
  misc_feature (8)..(8): n is a, c, g, or t
aatgtttntggaagaggtggaacggttggcagaggaggtggtcccagtcatcttgctatattatctcaaccactagacacgatacaaggatcacttcgtgtaacagttcaaggcgaggtcatagagcactcatttggagaggaacacttgtgcttcagaactctgcaacgtttcactgcagctactcttgagcatggaatgcatcctccaatttcacccaagccagaatggcgtgctataatggatgagatggctgtagtggcaacaaaagaatatcgatcaattgtcttccaagaaccacgttttgtcgaatacttccgctcggcaacacctgagactgaatatggtcggatgaatattggtagccggccatcaaagagaaagcctagtggaggcatagaatcgctccgtgcaattccatggatctttgcttggacacagacgaggtttcatcttcctgtatggcttggatttggtgcagcgttcaaacatatcatgcagaaggacatcaggaatatccatactctgaaagaaatgtacaatgagtggccattctttagggtcacccttgacttgcttgagatggtttttgccaagggagatccagggattgctgctttatatgacaaattgcttgtgtctgaagatctgcagccctttggggagcagctgagaaacaactttgaagagacgaaacagttactccttcaggttgctggccacaaggacgttcttgaaggggatccttacctgaagcagcgtctgcgggtgcgtgagtcatac

SEQ ID NO: 194 - DNA, 764 bp, Lolium perenne
  misc_feature (4)..(4): n is a, c, g, or t
gcanaggaggtggtcccagtcatcttgctatattatctcaaccaccagacacgatacaaggatcacttcgtgtaacagttcaaggcgaggtcatagagcactcatttggagaggaacacttgtgcttcagaactctgcaacgtttcactgcagctactcttgagcatggaatgcatcctccaatttcacccaagccagaatggcgtgctataatggatgagatggctgtagtggcaacaaaagaatatcgatcaattgtcttccaagaaccacgttttgtcgaatacttccgctcggcaacacctgagactgaatatggtcggatgaatattggtagccggccatcaaagagaaagcctagtggaggcatagaatcgctccgtgcaattccatggatctttgcttggacacagacaaggtttcatcttcctgtatggcttggatttggtgcagcgttcaaacatatcatgcagaaggacatcaggaatatccatactctgaaagaaatgtacaatgagtggccattctttagggtcacccttgacttgcttgagatggtttttgccgagggagatccaggaattgctgctttatatgacaaattgcttgtgtctgaagatctgcagccctttggggagcagctgagaaacaactttgaagagacgaaacagttactccttcaggttgctggccacaaggacgttcttgagggggatccttacctgaagcagcgtctgcggttgcgtgagtcatacatcacaaca

SEQ ID NO: 195 - DNA, 666 bp, Lolium perenne
  misc_feature (10)..(10): n is a, c, g, or t
  misc_feature (81)..(81): n is a, c, g, or t
  misc_feature (538)..(538): n is a, c, g, or t
  misc_feature (542)..(542): n is a, c, g, or t
  misc_feature (557)..(557): n is a, c, g, or t
  misc_feature (610)..(610): n is a, c, g, or t
  misc_feature (642)..(642): n is a, c, g, or t
  misc_feature (648)..(648): n is a, c, g, or t
  misc_feature (659)..(659): n is a, c, g, or t
ggtttttgcnagggagatccggattgctgctttatatgacaaattgcttgtgtctgaagatctgcagccctttggggagcngctgagaaacaactttgaagagacgaaacagttactccttcaggttgctggccacaaggacgttcttgaaggggatccttacctgaagcagcgtctgcggttgcgtgagtcatacatcacaacattgaatgtttgccaagcctacaccctgaagcggataagagaccctagcttcgaggtgacaccgcagcaggcacctctgtcgaaggagttcgctgatgagaaggagccagctgagctggtgcaactgaaccgtgggagcgagtacgccccaggcctggaggacaccctcatccttaccatgaagggtattgctgtggaatgcaaaacacaggctaggccagtttgcctattggaataactgtcattccgtcagatggggcgtgaatatgtgtgttccccaaatgctagtgaaccctggaggcattttggccacttacatgccttttggttatgnatgnacttgatcttaatgncaagggttgttgaagcctgatctaaataaaatatggaacaatgatattctggnggatctaataatttgcttggctctggcatcgnaatagngatttggagtngtttaac

SEQ ID NO: 196 - DNA, 482 bp, Lolium perenne
  misc_feature (86)..(87): n is a, c, g, or t
  misc_feature (404)..(404): n is a, c, g, or t
  misc_feature (424)..(424): n is a, c, g, or t
  misc_feature (448)..(448): n is a, c, g, or t
ggacgttcttgaaggggatccttacctgaagcagcgtctgcggttgcgtgagtcatacatcacaacattgaatgtttgccaagcgnncaccctgaagcggataagagaccctagcttcgaggtgacaccgcagcaggcacctctgtcgaaggagttcgctgatgagaaggagccagctgagctggtgcaactgaaccgtgggagcgagtacgccccaggcctggaggacaccctcatccttaccatgaagggtatttgctgtggaatgcaaaacacaggctaggccagtttgcctatttggaataactgtcatcccgtcagatgggcgtgaatatgtgtgttccccaaatgctagtgaaccctggaggcatttggccacttacatgccttttggttatggatgnactttgatcttaatgtcaanggttgttgaagcctgatctaaatnaaatatggaacaatgatattctggttgtttctta

SEQ ID NO: 197 - DNA, 224 bp, Lolium perenne
  misc_feature (5)..(5): n is a, c, g, or t
  misc_feature (11)..(11): n is a, c, g, or t
  misc_feature (15)..(15): n is a, c, g, or t
  misc_feature (19)..(19): n is a, c, g, or t
  misc_feature (34)..(34): n is a, c, g, or t
  misc_feature (44)..(44): n is a, c, g, or t
  misc_feature (160)..(160): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (194)..(194): n is a, c, g, or t
  misc_feature (199)..(199): n is a, c, g, or t
  misc_feature (205)..(205): n is a, c, g, or t
  misc_feature (213)..(213): n is a, c, g, or t
  misc_feature (222)..(222): n is a, c, g, or t
agcantctgtncttnccancaaccacgttttgtncgaatacttnccgctcggcaacacctgcacactgaatatggtcggcatgaatattggtagccggccatcaaagagaaagcctagtggaggcatagaatcgctccgtgcaattccatgcatctttgnttggacacagacaaggnttnatnttcctgtatgncttgnattcgnctccaccnccacccccnta

SEQ ID NO: 198 - protein, 73 aa, Lolium perenne
  misc_feature (1)..(1): Xaa can be any naturally occurring amino acid
  misc_feature (3)..(3): Xaa can be any naturally occurring amino acid
  misc_feature (5)..(6): Xaa can be any naturally occurring amino acid
  misc_feature (11)..(11): Xaa can be any naturally occurring amino acid
  misc_feature (14)..(14): Xaa can be any naturally occurring amino acid
  misc_feature (53)..(53): Xaa can be any naturally occurring amino acid
  misc_feature (59)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (68)..(68): Xaa can be any naturally occurring amino acid
  misc_feature (71)..(71): Xaa can be any naturally occurring amino acid
XSXLXXNHVLXEYXPLGNTCTLNMVGMNIGSRPSKRKPSGGIESLRAIPCIFXWTQTRXXXPVXLXFXSTXTP

SEQ ID NO: 199 - DNA, 527 bp, Lolium perenne
  misc_feature (4)..(4): n is a, c, g, or t
  misc_feature (12)..(12): n is a, c, g, or t
gttnctggaacnaaggatcttcttgaaggtgatccctacctgaagcagcggctccgcctccgtgacgcgtacatcaccaccatgaacgtatgccaggcctacacattgaagcggatccgtgacccagactaccacgtcgcactgcggccccatctttccaaggaggttatggacacaagcaagccggcttccgagcttgtgacgctgaacccggccagcgagtacgccccggggctggaggacaccctcatcttgaccatgaagggcgttgctgccggtctgcaaaacaccggttagggccaggagagatgcctgatcaccatctttttgtatcttcatgatgatgcgatgtttttctttagtcgtttgcggtgggccttatatctctcggacgtagctgcatctgtctccctgctcagtgaggaataatggcgtttcgcccaagtatattgataaataaagggaaccgatgttaatttcagatttgtttgttagtaattgttctatttattttgcgaaaaaaaaaa

SEQ ID NO: 200 - protein, 98 aa, Lolium perenne
  misc_feature (2)..(2): Xaa can be any naturally occurring amino acid
  misc_feature (4)..(4): Xaa can be any naturally occurring amino acid
VXGXKDLLEGDPYLKQRLRLRDAYITTMNVCQAYTLKRIRDPDYHVALRPHLSKEVMDTSKPASELVTLNPASEYAPGLEDTLILTMKGVAAGLQNTG

SEQ ID NO: 201 - DNA, 450 bp, Lolium perenne
  misc_feature (31)..(31): n is a, c, g, or t
  misc_feature (302)..(302): n is a, c, g, or t
  misc_feature (368)..(368): n is a, c, g, or t
  misc_feature (375)..(375): n is a, c, g, or t
  misc_feature (382)..(382): n is a, c, g, or t
  misc_feature (393)..(393): n is a, c, g, or t
  misc_feature (413)..(413): n is a, c, g, or t
  misc_feature (417)..(418): n is a, c, g, or t
  misc_feature (420)..(420): n is a, c, g, or t
  misc_feature (422)..(422): n is a, c, g, or t
  misc_feature (426)..(426): n is a, c, g, or t
  misc_feature (445)..(445): n is a, c, g, or t
gttacacgcgcagtttgcttgttagcaaggnagatggctgctaacttgtacttctctcagatagaagatctgatgtttgagctctctatgtggcgctgcagtgatgaacttagggtccgtgcagatgaagtacatctgtcctcaaaaaaaaaatctgcaaagcattacatagagttctggaagcaagttcctccaaatgaaccttatcgtgtcatacttggcgatgtcagggataaactgtactatacgcgcgaacgttctcgccacatattgacaactggaatttcagacattccagaagngtcaacttttactaatgttgaactgtttctggaacctcttgagctgtgctacagatccttatcttnctgtggngacaaanctattgctganggaagccttcttgatttctngcgnncngnatcnactttgtgggcttactctngcgaa

SEQ ID NO: 202 - protein, 150 aa, Lolium perenne
  misc_feature (11)..(11): Xaa can be any naturally occurring amino acid
  misc_feature (101)..(101): Xaa can be any naturally occurring amino acid
  misc_feature (123)..(123): Xaa can be any naturally occurring amino acid
  misc_feature (125)..(125): Xaa can be any naturally occurring amino acid
  misc_feature (128)..(128): Xaa can be any naturally occurring amino acid
  misc_feature (131)..(131): Xaa can be any naturally occurring amino acid
  misc_feature (138)..(142): Xaa can be any naturally occurring amino acid
  misc_feature (149)..(149): Xaa can be any naturally occurring amino acid
VTRAVCLLARXMAANLYFSQIEDLMFELSMWRCSDELRVRADEVHLSSKKKSAKHYIEFWKQVPPNEPYRVILGDVRDKLYYTRERSRHILTTGISDIPEXSTFTNVELFLEPLELCYRSLSXCXDKXIAXGSLLDFXXXXXTLWAYSXE

SEQ ID NO: 203 - DNA, 644 bp, Lolium perenne
  misc_feature (15)..(15): n is a, c, g, or t
  misc_feature (28)..(28): n is a, c, g, or t
  misc_feature (38)..(38): n is a, c, g, or t
  misc_feature (46)..(46): n is a, c, g, or t
ggggtggtggccctnctcaccttgcctncctgtctcanccaccagncacaatcaacggatcactccgggtgactgttcaaggtgaagttattgagcagagctttggggaggaacacttgtgcttcaggacgctgcagcgtttcacagctgctactcttgagcatgggatgcgtccacccatttcaccaaagccagagtggcgagctcttcttgatgagatggctgtggttgcaactgaggaataccggtcaatcgtcttccaagaaccacgcttcgtcgagtatttccgccttgcaacaccagagacagagtatggcaggatgaatataggaagcaggccatcaaagagaaaaccaagtggtggcattgaatcactccgtgcaattccatggatcttcgcatggacgcagacacggttccaccttccagtctggttgggctttggtggtgcattcaagcatatcctcaagaaggacatcagaaatttccatatgctccaggagatgtacaacgagtggccatttttcagggtcacgatcgatcttgttgagatggtgttcgccaagggtaaccctggcattgctgccttgtatgacaggctcctggtttcagaggagctacagccactgggtgacaagctgagg

SEQ ID NO: 204 - protein, 214 aa, Lolium perenne
  misc_feature (5)..(5): Xaa can be any naturally occurring amino acid
  misc_feature (9)..(9): Xaa can be any naturally occurring amino acid
  misc_feature (12)..(12): Xaa can be any naturally occurring amino acid
  misc_feature (15)..(15): Xaa can be any naturally occurring amino acid
GGGPXHLAXLSXPPXTINGSLRVTVQGEVIEQSFGEEHLCFRTLQRFTAATLEHGMRPPISPKPEWRALLDEMAVVATEEYRSIVFQEPRFVEYFRLATPETEYGRMNIGSRPSKRKPSGGIESLRAIPWIFAWTQTRFHLPVWLGFGGAFKHILKKDIRNFHMLQEMYNEWPFFRVTIDLVEMVFAKGNPGIAALYDRLLVSEELQPLGDKLR

SEQ ID NO: 205 - DNA, 674 bp, Trifolium repens
  misc_feature (15)..(15): n is a, c, g, or t
  misc_feature (623)..(623): n is a, c, g, or t
  misc_feature (645)..(645): n is a, c, g, or t
  misc_feature (649)..(649): n is a, c, g, or t
  misc_feature (656)..(656): n is a, c, g, or t
ggcttcttaaaaacncactaaactcttttctattgttcttatttcttcgatctatttccaatggccaaagacccagttcgtgttcttgtcactggtgctgcaggacaaattgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagactaaacgttgaagtttctgatgtgaaaaatgttataatatgggggaaatnattcatcaactcaataccctgntgtnaaccacncaaccgttaaaatctcct

SEQ ID NO: 206 - protein, 201 aa, Trifolium repens
  misc_feature (188)..(188): Xaa can be any naturally occurring amino acid
  misc_feature (195)..(195): Xaa can be any naturally occurring amino acid
  misc_feature (197)..(197): Xaa can be any naturally occurring amino acid
  misc_feature (199)..(199): Xaa can be any naturally occurring amino acid
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMTKNVSIYKSQASALEKHAAANCKVLVVANPANTNALILKEYAPSIPEKNISALTRLDHNRALGQISERLNVEVSDVKNVIIWGKXFINSIPXCXPXNR

SEQ ID NO: 207 - DNA, 202 bp, Trifolium repens
  misc_feature (3)..(3): n is a, c, g, or t
  misc_feature (10)..(10): n is a, c, g, or t
  misc_feature (15)..(15): n is a, c, g, or t
  misc_feature (17)..(17): n is a, c, g, or t
  misc_feature (23)..(23): n is a, c, g, or t
  misc_feature (37)..(37): n is a, c, g, or t
  misc_feature (40)..(41): n is a, c, g, or t
  misc_feature (91)..(91): n is a, c, g, or t
  misc_feature (156)..(156): n is a, c, g, or t
  misc_feature (165)..(166): n is a, c, g, or t
  misc_feature (177)..(177): n is a, c, g, or t
  misc_feature (193)..(193): n is a, c, g, or t
gtnttcttgnaaacncnctaatntcttttctattgtnctnntttcttcgatctatttccaatggccaaagacccagttcgtgttcttgtcnctggtgctgcaggacaacttgggtatgctcttgtccctatgattgctaggggagtgatgctcggncctgaccannctgtgatcctncacatgcttgacattncacctggag

SEQ ID NO: 208 - DNA, 559 bp, Trifolium repens
  misc_feature (3)..(3): n is a, c, g, or t
  misc_feature (6)..(6): n is a, c, g, or t
  misc_feature (19)..(19): n is a, c, g, or t
  misc_feature (21)..(21): n is a, c, g, or t
  misc_feature (24)..(24): n is a, c, g, or t
gcnacntataacctctttntnctnacctctattgttcttatttcttcgatctatatccaatggccaaagacccagttcgtgttcttgtcactggtgctgcaggacaaattgggtatgctctcgtccctatgattgctaggggagtgatgctcggccctgaccagcctgtgatcctccacatgcttgacatcccacctgcagccgaatcactgaacggtgtaaaaatggagttggtggatgctgcattccctcttcttaaaggagttgttgctaccactgatgtggttgaggcatgcactggggtcaatattgccgttatggttggcgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcacttggtca

SEQ ID NO: 209 - DNA, 567 bp, Trifolium repens
  misc_feature (3)..(3): n is a, c, g, or t
gcntcttaaaaccactaaactcttttctattgttcttatttcttcgatctatttccaatggccaaagacccagttcgtgttcttgtcactggtgctgcaggacaaattgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaa

SEQ ID NO: 210 - DNA, 575 bp, Trifolium repens
gcatcttaaaaccactaaactcttttctattgttcttatttcttcgatctatttccaatggccaaagacccagttcgtgttcttgtcactggtgctgcaggacaaattgggtatgctcttgtccctatgattgctaggggagtgatgctcggccctgaccagcctgtgatcctccacatgcttgacattccacctgcagccgaatcactgaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagactaaa

SEQ ID NO: 211 - DNA, 606 bp, Trifolium repens
  misc_feature (7)..(7): n is a, c, g, or t
cttcttnaaaccactaaactcttttctattgttcttatttcttcgatctatttccatggccaaagacccagttcgtgttcttgtcactggtgctgcaggacaacttgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagactaaacgttgaagtttctgatgtgaaaaatgttataat

SEQ ID NO: 212 - DNA, 344 bp, Trifolium repens
  misc_feature (2)..(2): n is a, c, g, or t
  misc_feature (10)..(10): n is a, c, g, or t
  misc_feature (54)..(54): n is a, c, g, or t
  misc_feature (300)..(300): n is a, c, g, or t
  misc_feature (311)..(311): n is a, c, g, or t
  misc_feature (317)..(317): n is a, c, g, or t
  misc_feature (321)..(321): n is a, c, g, or t
  misc_feature (327)..(327): n is a, c, g, or t
  misc_feature (329)..(329): n is a, c, g, or t
  misc_feature (333)..(333): n is a, c, g, or t
  misc_feature (335)..(335): n is a, c, g, or t
  misc_feature (343)..(343): n is a, c, g, or t
cnttaaaacncactaaactcttttctattgttcttatttcttcgatctatttcnatggccaaagacccagttcgtgttcttgtcactggtgctgcaggacaacttgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtnaatattgacgntatggntggngggttncntacnanacaacgtnt

SEQ ID NO: 213 - DNA, 558 bp, Trifolium repens
  misc_feature (4)..(4): n is a, c, g, or t
  misc_feature (16)..(16): n is a, c, g, or t
  misc_feature (27)..(27): n is a, c, g, or t
gcantaaactcttttntattgttcttntttcttcgatctatttccatggccaagacccagttcgtgttcttgtcactggtgctgcaggacaaattgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagac

SEQ ID NO: 214 - DNA, 599 bp, Trifolium repens
  misc_feature (4)..(4): n is a, c, g, or t
gcantaaactcttttctattgttcttatttcttcgatctatttccatggccaagacccagttcgtgttcttgtcctggtgctgcaggacaaattgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagactaaacgttgaagtttctgatgtgaaaaatgttataatctggg

SEQ ID NO: 215 - DNA, 577 bp, Trifolium repens
  misc_feature (24)..(24): n is a, c, g, or t
cactaactcttttctttgttcttntttcttcgatcatttccatggccaagacccagttcgtgttcttgtactggtgctgcaggacaacttgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagactaaacgttgaagtttctgatgtgg

SEQ ID NO: 216 - DNA, 594 bp, Trifolium repens
  misc_feature (10)..(10): n is a, c, g, or t
  misc_feature (23)..(23): n is a, c, g, or t
taaactcttntctattgttcttntttcttcgatctatttccatggccaagacccagttcgtgttcttgtcactggtgctgcaggacaaattgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctagaaaagaaggtatggagaggaaagatgtgatgacaaaaaatgtctctatttacaagtctcaggcttctgcccttgaaaaacatgctgctgcaaactgcaaggttcttgttgttgccaacccagcaaacaccaatgcattgatcttgaaggaatatgctccatccattcctgagaaaaacatttctgctttgactagattggaccataacagggcactaggtcaaatttctgaaagactaaacgttgaagtttctgatgtgaaaaatgttataatctg

SEQ ID NO: 217 - DNA, 653 bp, Trifolium repens
  misc_feature (319)..(319): n is a, c, g, or t
  misc_feature (327)..(327): n is a, c, g, or t
  misc_feature (387)..(387): n is a, c, g, or t
  misc_feature (432)..(432): n is a, c, g, or t
  misc_feature (480)..(480): n is a, c, g, or t
  misc_feature (490)..(490): n is a, c, g, or t
  misc_feature (501)..(501): n is a, c, g, or t
  misc_feature (546)..(546): n is a, c, g, or t
  misc_feature (552)..(552): n is a, c, g, or t
  misc_feature (570)..(570): n is a, c, g, or t
  misc_feature (602)..(602): n is a, c, g, or t
  misc_feature (624)..(624): n is a, c, g, or t
  misc_feature (628)..(628): n is a, c, g, or t
  misc_feature (635)..(635): n is a, c, g, or t
aaactcttttctattgttcttatttcttcgatctatttccaatggccaaagacccagttcgtgttcttgtcactggtgctgcaggacaaattgggtatgctcttgtccctatgattgctaggggagtgatgctcggccctgaccagcctgtgatcctccacatgcttgacattccacctgcagccgaatcactcaacggtgttaaaatggagttggtggatgctgcattccctcttcttaaaggagttgttgctacaactgatgtggttgaggcatgcactggtgtcaatattgccgttatggttggtgggttccctanaaaagaangtatggagaggaaagatgtgatgacaaaaatgtctctatttacaagtcttaagcttttgnccttgaaaaacatgctgctgcaaactgcaaggttcttgttgttgncaacccaccaaacaccaatgcattgatcttgaaggaatatgctccatncattcctganaaaaacatttntgctttgactagattggaccataacagggcactagggcaaatttntgaaanactaaacgttgaagtttntgatgtgaaaaatgttatatatgggggaaatnattcatcaactcaataccctgntgtnaaccacncaaccgttaaaatctcct

SEQ ID NO: 218 - DNA, 1111 bp, Trifolium repens
  misc_feature (9)..(9): n is a, c, g, or t
  misc_feature (14)..(15): n is a, c, g, or t
  misc_feature (20)..(20): n is a, c, g, or t
  misc_feature (27)..(27): n is a, c, g, or t
  misc_feature (55)..(55): n is a, c, g, or t
  misc_feature (66)..(66): n is a, c, g, or t
ttctcccanaatcnngaaancgcccanacatcacacaacataacaccttactctnctttctctctnaacaaaaactgttcttcctctcttaatcttccctgttcgattccttccatttcttcaaaaatggccaaagacccagttcgtgttctcgtcactggtgctgcagggcaaattggttatgcacttgtccctatgattgctaggggagtgatgcttggtcctgatcaacctgtgatccttcacatgcttgatattcctccagcagcagagtcattgaatggagttaagatggagttggtcgatgctgcatttccacttcttaaaggtgttgttgctacaactgatgttgttgaagcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattgaatgttcaagtttctgatgtaaagaatgtcattatctggggtaatcattcatcaactcagtatcctgatgtcaaccatgcaactgttaacacccccgctggggagaagcctgtccgtgagcttgtttctgatgacgcctggttgaatggagaattcatatctaccgttcaacaacgtggtgctgcaattattaaggctagaaagctttcaagcgcactatccgctgctagcgctgcttgcgaccacattcgcgattgggttcttggaactccccagggcaccttcgtttcaatgggagtgtattctgatggttcttacaacgtaccagctggactcatctattcattccctgtcaccactgctaatggggaatggaaaattgttcaaggactttcaattgacgagttctcaaggaagaagttggacttgacagctgaagagttatccgaggaaaagagtttggcatact

SEQ ID NO: 219 - protein, 328 aa, Trifolium repens
MAKDPVRVLVTGAAGQIGYALVPMIARGVMLGPDQPVILHMLDIPPAAESLNGVKMELVDAAFPLLKGVVATTDVVEACTGVNIAVMVGGFPRKEGMERKDVMSKNVSIYKSQASALEKHAAANCKVLVVANPANTNALILKEFAPSIPEKNISCLTRLDHNRALGQISERLNVQVSDVKNVIIWGNHSSTQYPDVNHATVNTPAGEKPVRELVSDDAWLNGEFISTVQQRGAAIIKARKLSSALSAASAACDHIRDWVLGTPQGTFVSMGVYSDGSYNVPAGLIYSFPVTTANGEWKIVQGLSIDEFSRKKLDLTAEELSEEKSLAY

SEQ ID NO: 220 - DNA, 323 bp, Trifolium repens
  misc_feature (8)..(9): n is a, c, g, or t
  misc_feature (14)..(15): n is a, c, g, or t
  misc_feature (20)..(20): n is a, c, g, or t
  misc_feature (22)..(22): n is a, c, g, or t
  misc_feature (286)..(286): n is a, c, g, or t
  misc_feature (295)..(295): n is a, c, g, or t
  misc_feature (299)..(300): n is a, c, g, or t
  misc_feature (314)..(314): n is a, c, g, or t
  misc_feature (317)..(317): n is a, c, g, or t
ttctcccnnaatcnngaaancncgcacacaacactaaactactactctctaaacaaaactgttcttcctctcttaatcttccctgtttgattccttccagttcttcaaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagatggncgatgctgnattnncacttgttaaaggngangctgct

SEQ ID NO: 221 - DNA, 350 bp, Trifolium repens
  misc_feature (6)..(6): n is a, c, g, or t
  misc_feature (9)..(9): n is a, c, g, or t
  misc_feature (14)..(15): n is a, c, g, or t
  misc_feature (20)..(20): n is a, c, g, or t
  misc_feature (314)..(314): n is a, c, g, or t
  misc_feature (320)..(320): n is a, c, g, or t
  misc_feature (336)..(336): n is a, c, g, or t
  misc_feature (341)..(341): n is a, c, g, or t
  misc_feature (344)..(346): n is a, c, g, or t
ttctcncanaatcnngaaancccgcaaaacactaaactactactctctaaacaaaactgttcttcctctcttaatcttccctgtttgattccttccagttcttcaaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttgttaaaggtgntgatgntacaactgatgatggngacgnatnnnctgg

SEQ ID NO: 222 - DNA, 585 bp, Trifolium repens
  misc_feature (2)..(3): n is a, c, g, or t
  misc_feature (20)..(20): n is a, c, g, or t
  misc_feature (39)..(39): n is a, c, g, or t
gnnaccacaacacaacacancactaaccctcactctctnaaacaaaaactgttcttccactcttaatcttccctgttcgattccttctatttcttcaaaaatggccaaagacccagttcgtgttctcgtcactggtgctgcaggccaaattggttatgcacttgtccctatgattgctaggggagtgatgcttggtcctgatcaacctgtgatccttcacatgcttgatatccctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaa

SEQ ID NO: 223 - DNA, 593 bp, Trifolium repens
  misc_feature (4)..(4): n is a, c, g, or t
  misc_feature (25)..(25): n is a, c, g, or t
  misc_feature (28)..(29): n is a, c, g, or t
  misc_feature (36)..(36): n is a, c, g, or t
  misc_feature (44)..(44): n is a, c, g, or t
gttntcaacacaacactcacccttnctnnctctctnaaacaaangctattcttcatctcttaatcttcgcggttcgattccttccgtttcttcagcaatggccaaagacccagttcgtgtcctcgttactggtgctgcaggccaaattggttatgcacttgtccctatgattgctaggggagtgatgcttggtcctgatcaacctgtgatccttcacatgcttgatatccctccagcagcagagtcattgaatggagttaaaatggagttggtggatgctgcatttccacttcttaaaggcgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattgg

SEQ ID NO: 224 - DNA, 531 bp, Trifolium repens
  misc_feature (3)..(3): n is a, c, g, or t
  misc_feature (6)..(6): n is a, c, g, or t
  misc_feature (28)..(28): n is a, c, g, or t
  misc_feature (32)..(32): n is a, c, g, or t
  misc_feature (39)..(39): n is a, c, g, or t
  misc_feature (42)..(42): n is a, c, g, or t
  misc_feature (477)..(477): n is a, c, g, or t
  misc_feature (486)..(486): n is a, c, g, or t
  misc_feature (497)..(497): n is a, c, g, or t
  misc_feature (520)..(520): n is a, c, g, or t
  misc_feature (528)..(528): n is a, c, g, or t
gcncanacataacacaacactaaacctnactnctctctnaanaaaactgttcttcctctcttaatcttccctgtttgattccttccgttcttcaaaaatggccaaagacccagttcgtgttctcgtcactggtgctgcagggcaaattggttatgcacttgtccctatgattgctaggggagtgatgcttggtcctgatcaacctgtgatccttcacatgcttgatattcctccagcagcagagtcattgaatggagttaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggntttggttgntgctaacccancaacaccaatgcattgatcttgnaggaatcngct

SEQ ID NO: 225 - DNA, 573 bp, Trifolium repens
  misc_feature (20)..(20): n is a, c, g, or t
  misc_feature (24)..(24): n is a, c, g, or t
  misc_feature (31)..(31): n is a, c, g, or t
  misc_feature (238)..(238): n is a, c, g, or t
gcaaacacaacactaacctnactnctctctnaacaaaactattcttcatctcttaatcttcgcggttcgattccttccgggtcttcagcaatggccaaagacccagttcgtgtcctcgttactggtgctgcaggccaaattggttatgcacttgtccctatgattgctaggggagtgatgcttggtcctgatcaacctgtgatccttcacatgcttgatatccctccagcagcagagncattgaatggagttaaaatggagttggtggatgctgcatttccacttcttaaaggcgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcac

SEQ ID NO: 226 - DNA, 603 bp, Trifolium repens
  misc_feature (15)..(15): n is a, c, g, or t
  misc_feature (24)..(24): n is a, c, g, or t
  misc_feature (30)..(31): n is a, c, g, or t
  misc_feature (48)..(48): n is a, c, g, or t
tttacgtaaccctanactccactncttctnnaacaaaaactattcttnatctcttaatcttcgcggttcgattccttccgtttcttcagcaatggccaaagacccagttcgtgtcctcgttactggtgctgcaggccaaattggttatgcacttgtccctatgattgctaggggagtgatgcttggtcctgatcaacctgtgatccttcacatgcttgatatccctccagcagcagagtcattgaatggagttaaaatggagttggcggatgctgcatttccacttcttaaaggcgttgttgctacaactgatgttgttgaagcatgcactggagtcaatattgcagtcatggttggtggattcccaagaaaagaaggtatggagaggaaggatgtgatgactaagaatgtctctatttacaagtcccaggcttcagcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattgggccaaatttctgaaag

SEQ ID NO: 227 - DNA, 597 bp, Trifolium repens
  misc_feature (2)..(2): n is a, c, g, or t
  misc_feature (20)..(21): n is a, c, g, or t
  misc_feature (24)..(24): n is a, c, g, or t
  misc_feature (29)..(30): n is a, c, g, or t
gnaccacctaaccctcactnnctnctctnnaacaaaaactattcttcatctcttaatcttcgcggttcgattccttccgtttcttcagcaatggccaaagacccagttcgtgtcctcgttactggtgctgcaggccaaattggttatgcacttgtccctatgattgctaggggagtgatgcttggtcctgatcaacctgtgatccttcacatgcttgatatccctccagcagcagagtcattgaatggagttaaaatggagttggtggatgctgcatttccacttcttaaaggcgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattgggccaaatttct

SEQ ID NO: 228 - DNA, 333 bp, Trifolium repens
  misc_feature (2)..(2): n is a, c, g, or t
  misc_feature (4)..(4): n is a, c, g, or t
  misc_feature (15)..(15): n is a, c, g, or t
  misc_feature (19)..(19): n is a, c, g, or t
  misc_feature (218)..(218): n is a, c, g, or t
  misc_feature (221)..(221): n is a, c, g, or t
  misc_feature (227)..(227): n is a, c, g, or t
  misc_feature (263)..(263): n is a, c, g, or t
  misc_feature (267)..(268): n is a, c, g, or t
  misc_feature (329)..(329): n is a, c, g, or t
  misc_feature (332)..(333): n is a, c, g, or t
gnancctcactactnctcnaacaaaaactgttcttccctcttaatcttccctgttcgattccttctatttcttcaaaaatggccaaagacccagttcgtgttctcgtcactggtgctgcaggccaaattggttatgcacttgtccctatgattgctaggggagtgatgcttggtcctgatcaacctgtgatccttgacatgcttgatattgctgcagnagnagagtnattgaatggagctaaaatggagctgccggatgctgnattnnaacttcttacaggcgccgccgctaccactgatgctgcccaaccatgccctgcacccatatnccnn

SEQ ID NO: 229 - DNA, 567 bp, Trifolium repens
  misc_feature (3)..(3): n is a, c, g, or t
  misc_feature (18)..(18): n is a, c, g, or t
  misc_feature (37)..(37): n is a, c, g, or t
  misc_feature (91)..(91): n is a, c, g, or t
  misc_feature (126)..(126): n is a, c, g, or t
  misc_feature (378)..(378): n is a, c, g, or t
  misc_feature (551)..(551): n is a, c, g, or t
cancactaaacctactcncactctcaaacaaaactgntcttcctctcttaacttccctgttcgattccttccacttcttcaaaaatggccnaagacccagttcgtgttctcgtcactggtgctgcngggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttcttaaaggtgttgttgctacaactgatgttgttgaggcatgcactggagtcaatatcgcagtcatggttggtggattcccaagaaaagaaggtatgganaggaaggatgttatgtctaagaacgtctctatttacaagtcccaagcttctgcccttgaaaagcatgctgctgccaactgcaaggttttggttgttgctaacccagcaaacaccaatgcattgatcttgaaggaatttgctccatctattccagagaaaaacatttcttgttngactagacttgatcac

SEQ ID NO: 230 - DNA, 569 bp, Trifolium repens
  misc_feature (20)..(20): n is a, c, g, or t
  misc_feature (27)..(27): n is a, c, g, or t
caaacacacctaacctactnctctctnaacaaaactgttcttcctctcttaatcttccctgtttgattccttccagttcttcaaaaatggccaaagacccagttcgtgttctcgtcactggtgctgcagggcaaattggttatgcacttgtccctatgattgctaggggagtgatgcttggtcctgatcaacctgtgatccttcacatgcttgatattcctccagcagcagagtcattgaatggagttaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaacaccaatgcattgatcttgaaggaatttgctccatctattccagagaaaaacatttcttgtttgactagacttgatcacc

SEQ ID NO: 231 - DNA, 592 bp, Trifolium repens
  misc_feature (17)..(17): n is a, c, g, or t
  misc_feature (28)..(28): n is a, c, g, or t
  misc_feature (52)..(52): n is a, c, g, or t
aacactaaaccctactnctctctctctnaacaaaactgttcttcctctcttnatcttccctgttcgattccttccacttcttcaaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttcttaaaggtgttgttgctacaactgatgttgttgaggcatgcactggagtcaatatcgcagtcatggttggtggattcccaagaaaagaaggtatggagaggaaggatgttatgtctaagaacgtctctatttacaagtcccaagcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaattt

SEQ ID NO: 232 - DNA, 585 bp, Trifolium repens
  misc_feature (2)..(2): n is a, c, g, or t
  misc_feature (10)..(10): n is a, c, g, or t
  misc_feature (15)..(15): n is a, c, g, or t
  misc_feature (22)..(22): n is a, c, g, or t
  misc_feature (26)..(26): n is a, c, g, or t
cntaaccctnactcnctctctnaaanaaaactattcttatctcttaatcttcgcggttcgattccttccgtttcttcagcaatggccaaagacccagttcgtttcctcgttactggtgctgcaggccaaattggttatgcacttgtccctatgattgctaggggagtgatgcttggtcctgatcaacctgtgatccttcacatgcttgatatccctccagcagcagagtcattgaatggagttaaaatggagttggtggatgctgcatttccacttcttaaaggcgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattgggccaaatt

SEQ ID NO: 233 - DNA, 462 bp, Trifolium repens
  misc_feature (10)..(10): n is a, c, g, or t
  misc_feature (13)..(13): n is a, c, g, or t
  misc_feature (16)..(16): n is a, c, g, or t
  misc_feature (20)..(20): n is a, c, g, or t
  misc_feature (87)..(87): n is a, c, g, or t
  misc_feature (392)..(392): n is a, c, g, or t
gtcatcactnctnctncaanaaaaactgttcttccactcttaatcttccctgttcgattccttctatttcttcaaaaatggccaaanacccagttcgtgttctcgtcactggtgctgcaggccaaattggttatgcacttgtccctatgattgctaggggagtgatgcttggtcctgatcaacctgtgatccttcacatgcttgatattcctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtatggagaggaaggatgtgatgactaanaatgtctctatttacaagtcccaggcttctgcccttgaaaagcatgctgctgccaactgcaaggttttgg

SEQ ID NO: 234 - DNA, 573 bp, Trifolium repens
  misc_feature (11)..(12): n is a, c, g, or t
  misc_feature (15)..(15): n is a, c, g, or t
cactaaacctnnctnctctctctctaaacaaaactgttcttcctctcttaatcttccctgttcgattccttccacttcttcaaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttcttaaaggtgttgttgctacaactgatgttgttgaggcatgcactggagtcaatatcgcagtcatggttggtggattcccaagaaaagaaggtatggagaggaaggatgttatgtctaagaacgtctctatttacaagtcccaagcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacag

SEQ ID NO: 235 - DNA, 603 bp, Trifolium repens
  misc_feature (2)..(2): n is a, c, g, or t
  misc_feature (8)..(8): n is a, c, g, or t
  misc_feature (16)..(16): n is a, c, g, or t
  misc_feature (19)..(19): n is a, c, g, or t
  misc_feature (26)..(26): n is a, c, g, or t
  misc_feature (50)..(50): n is a, c, g, or t
gnaccacntaaaactnctnctctctnaacaaaactgttcttcctctcttnatcttccctgtttgattccttccgttcttcaaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttcttaaaggtgttgttgctacaactgatgttgttgaggcatgcactggagtcaatatcgcagtcatggttggtggattcccaagaaaagaaggtatggagaggaaggatgttatgtctaagaacgtctctatttacaagtcccaagcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattgaat

SEQ ID NO: 236 - DNA, 550 bp, Trifolium repens
  misc_feature (6)..(6): n is a, c, g, or t
  misc_feature (17)..(17): n is a, c, g, or t
  misc_feature (462)..(462): n is a, c, g, or t
  misc_feature (482)..(482): n is a, c, g, or t
  misc_feature (532)..(532): n is a, c, g, or t
  misc_feature (545)..(545): n is a, c, g, or t
accacntaaccctcctnctctcaaacaaaaactgttcttccctcttaatcttccctgttcgattccttctatttcttcaaaaatggccaaagacccagttcgtgttctcgtcactggtgctgcaggccaaattggttatgcacttgtccctatgattgctaggggagtgatgcttggtcctgatcaacctgtgatccttcacatgcttgatattcctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggntttgggtattgctaacccancaaataccaatgcattgatcttgaaggagtttgctccatctattccaganaaaaacatttcanctttg

SEQ ID NO: 237 - DNA, 591 bp, Trifolium repens
  misc_feature (5)..(5): n is a, c, g, or t
  misc_feature (12)..(12): n is a, c, g, or t
  misc_feature (15)..(15): n is a, c, g, or t
acacntaacctnctnctctctcaacaaaactgttcttcctctcttaatcttccctgtttgattccttccgttcttcaaaaatggccaaagacccagttcgtgttctcgtcactggtgctgcagggcaaattggttatgcacttgtccctatgattgctaggggagtgatgcttggtcctgatcaacctgtgatccttcacatgcttgatattcctccagcagcagagtcattgaatggagttaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaacaccaatgcattgatcttgaaggaatttgctccatctattccagagaaaaacatttcttgtttgactagacttgatcacaacagggcattgggccaaatttctgaaag

SEQ ID NO: 238 - DNA, 571 bp, Trifolium repens
  misc_feature (4)..(4): n is a, c, g, or t
  misc_feature (16)..(17): n is a, c, g, or t
gtancctcactctctnnaacaaaaactgttcttccctcttaatcttccctgttcgattccttctatttcttcaaaaatggccaaagacccagttcgtgttctcgtcactggtgctgcaggccaaattggttatgcacttgtccctatgattgctaggggagtgatgcttggtcctgatcaacctgtgatccttcacatgcttgatattcctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattg

SEQ ID NO: 239 - DNA, 433 bp, Trifolium repens
  misc_feature (9)..(9): n is a, c, g, or t
  misc_feature (28)..(28): n is a, c, g, or t
  misc_feature (358)..(358): n is a, c, g, or t
  misc_feature (386)..(386): n is a, c, g, or t
  misc_feature (402)..(402): n is a, c, g, or t
  misc_feature (404)..(406): n is a, c, g, or t
  misc_feature (409)..(409): n is a, c, g, or t
  misc_feature (413)..(413): n is a, c, g, or t
  misc_feature (416)..(416): n is a, c, g, or t
  misc_feature (430)..(430): n is a, c, g, or t
gcatctctnaaacaaaaactgttcttcnctcttaatcttccctgttcgattccttctatttcttcaaaaatggccaaagacccagttcgtgttctcgtcactggtgctgcaggccaaattggttatgcacttgtccctatgattgctaggggagtgatgcttggtcctgatcaacctgtgatccttcacatgcttgatattcctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtntggagaggaaggatgtgatgactaagantgtctctatttacaanannnagncttntgnccttgaaaaagatnctg

SEQ ID NO: 240 - DNA, 585 bp, Trifolium repens
  misc_feature (10)..(10): n is a, c, g, or t
  misc_feature (35)..(35): n is a, c, g, or t
tcaccctctnaacaaaaactgttcttcctcccttnatcttccctgtttgattccttccgttcttcaaaaatggccaaagacccagttcgtgttctcgtcactggtgctgcagggcaaattggttatgcacttgtccctatgattgctaggggagtgatgcttggtcctgatcaacctgtgatccttcacatgcttgatattcctccagcagcagagtcattgaatggagttaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattg

SEQ ID NO: 241 - DNA, 610 bp, Trifolium repens
  misc_feature (6)..(6): n is a, c, g, or t
  misc_feature (30)..(30): n is a, c, g, or t
tctctnaacaaaaactgttcttccctcttnatcttccctgttcgattccttctatttcttcaaaaatggccaaagacccagttcgtgttctcgtcactggtgctgcaggccaaattggttatgcacttgtccctatgattgctaggggagtgatgcttggtcctgatcaacctgtgatccttcacatgcttgatattcctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattgggccaaatttctgaaagattgaatattcaagtttctgatgtaaagaatgt

SEQ ID NO: 242 - DNA, 568 bp, Trifolium repens
  misc_feature (23)..(23): n is a, c, g, or t
  misc_feature (53)..(53): n is a, c, g, or t
caaaaactgctcttcctctcttnatcttccctgttcgattccttcccttcttnaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttcttaaaggtgttgttgctacaactgatgttgttgaggcatgcactggagtcaatatcgcagtcatggttggtggattcccaagaaaagaaggtatggagaggaaggatgttatgtctaagaacgtctctatttacaagtcccaagcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaag

SEQ ID NO: 243 - DNA, 558 bp, Trifolium repens
  misc_feature (21)..(21): n is a, c, g, or t
aaaactgttcttcctctcttnatcttccctgttcgattccttcccttcttcaaaaatggccaaagacccagttcgtgttctcgtcactggtgctgcagggcaaattggttatgcacttgtccctatgattgctaggggagtgatgcttggtcctgatcaacctgtgatcctacacatgcttgatattccacccgcagcagagtcattgaatggagttaagatggagttggtcgatgctgcatttccacttcttaaaggtgttgttgctacaactgatgttgttgaggcatgcactggagtcaatatcgcagtcatggttggtggattcccaagaaaagaaggtatggagaggaaggatgttatgtctaagaacgtctctatttacaagtcccaagcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaat

SEQ ID NO: 244 - DNA, 752 bp, Trifolium repens
  misc_feature (2)..(3): n is a, c, g, or t
gnnttcttcctctcttcaacttccctgtttgattccttccagttcttcaaaaatggccaaagacccagttcgtgttctcgtcactggtgctgcagggcaaattggttatgcacttgtccctatgattgctaggggagtgatgcttggtcctgatcaacctgtgatccttcacatgcttgatattcctacagcagcagagtcattgaatggagttaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacctgatcacaacagggcattgggccaaatttctgaaagattgaatgttcaagtttctgatgtaaagaatgtcattatctggggtaatcattcatcaactcagtatcctgatgtcaaccatgcaactgttaacacccccgctggggagaagcctgtccgtgagcttgtttctgatgacgcctggttgaatggagaattcatatctaccgttcaacaacgtggtgctg

SEQ ID NO: 245 - DNA, 583 bp, Trifolium repens
  misc_feature (17)..(17): n is a, c, g, or t
  misc_feature (46)..(46): n is a, c, g, or t
ggttcttccctcttatncttccctgttcgattccttctatttcttnaaaatggccaaagacccagttcgtgttctcgtcactggtgctgcaggccaaattggttatacacttgtccctatgattgctaggggagtgatgcttggtcctgatcaacctgtgatccttcacatgcttgatattcctccagcagcagagtcattgaatggagttaaaatggagttggtggatgctgcatttccacttcttaaaggtgttgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcatgctgctgccaactgcaaggttttggttattgctaacccagcaaataccaatgcattgatcttgaaggagtttgctccatctattccagagaaaaacatttcagctttgactagacttgatcacaacagggcattgggccaaatttctgaaagattgaatattcaagtttctgat

SEQ ID NO: 246 - DNA, 573 bp, Trifolium repens
  misc_feature (11)..(11): n is a, c, g, or t
ttcctctcttnatcttccctgtttgattccttccgttcttcaaaatggccaagacccagttcgtgttctcgtcactggtgctgcagggcaaattggttatgcacttgtccctatgattgctaggggagtgatgcttggtcctgatcaacctgtgatccttcacatgcttgatattcttccagcagcagagtcattgaatggagttaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattgaatgttcaagtttc

SEQ ID NO: 247 - DNA, 562 bp, Trifolium repens
  misc_feature (24)..(24): n is a, c, g, or t
  misc_feature (38)..(38): n is a, c, g, or t
ggggagtgatgcttggtcctgatnacctgtgatccttncatgcttgatatccctccagcagcagagtcattgaatggagttaaaatggagttggtggatgctgcatttccacttcttaaaggcattgttgctacaactgatgttgttgaagcatgcactggagtcaatattgcagtcatggttggtggattcccaagaaaagaaggtatggagaggaaggatgtgatgactaagaatgtctctatttacaagtcccaggcttctgcccttgaaaagcaagctgctgccaactgcaaggttttggttattgctaacccagcaaataccaatgcattgatcttgaaggagtttgctccatctattccagagaaaaacatttcagctttgactagacttgatcacaacagggcattgggccaaatttctgaaagattgaatattcaagtttctgatgtaaagaatgtcattatctggggtaatcattcatcaactcagtatcctgatgtcaaccatgcaactgttaacacccccgccggggagaagcctgtccgtgaacttgttt

SEQ ID NO: 248 - DNA, 515 bp, Trifolium repens
  misc_feature (1)..(1): n is a, c, g, or t
  misc_feature (9)..(9): n is a, c, g, or t
  misc_feature (11)..(11): n is a, c, g, or t
  misc_feature (17)..(17): n is a, c, g, or t
  misc_feature (22)..(22): n is a, c, g, or t
  misc_feature (367)..(367): n is a, c, g, or t
  misc_feature (427)..(427): n is a, c, g, or t
  misc_feature (482)..(482): n is a, c, g, or t
  misc_feature (488)..(489): n is a, c, g, or t
  misc_feature (500)..(500): n is a, c, g, or t
  misc_feature (510)..(510): n is a, c, g, or t
ntattcctncngcagcngagtnttgaatggagtaagatggagttggtcgatgctgcatttccacttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgngccaaatttctgaaagattgaatgtccaagtttctgatgtaaagaatgtcattatctggngtaatcattcatcaactcagcatcctgatgtcaaccatgcaactgttaacacccncgctgnngagaagcctgnccgtgagctngtttc

SEQ ID NO: 249 - DNA, 598 bp, Trifolium repens
  misc_feature (20)..(20): n is a, c, g, or t
tattcctccgcagcagagtnttgaatggagtaagatggagttggtcgatgctgcatttcccttcttaaaggtgttgttgctacaactgatgttgttgaggcatgcactggagtcaatattgcagtcatggttggtggattcccaagaaaagaaggtatggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattgaatgtccaagtttctgatgtaaagaatgtcattatctggggtaatcattcatcaactcagtatcctgatgtcaaccatgcaactgttaacacccccgctggggagaagcctgtccgtgagcttgtttctgatgacgcctggttgaatggagaattcatatctaccgttcaacaacgtggtgctgcaattattaaggctagaaagctttcaagtg

SEQ ID NO: 250 - DNA, 603 bp, Trifolium repens
ggagaggaaggatgtgatgtctaagaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattgaatgttcaagtttctgatgtaaagaatgtcattatctggggtaatcattcatcaactcagtatcctgatgtcaaccatgcaactgttaacacccccgctggggagaagcctgtccgtgagcttgtttctgatgacgcctggttgaatggagaattcatatctaccgttcaacaacgtggtgctgcaattattaaggctagaaagctttcaagcgcactatccgctgctagcgctgcttgcgaccacattcgcgattgggttcttggaactccccagggcaccttcgtttcaatgggagtgtattctgatggttcttacaacgtaccagctggactcatctattcattccctgtcaccactgctaatggggaatggaa

SEQ ID NO: 251 - DNA, 695 bp, Trifolium repens
  misc_feature (1)..(6): n is a, c, g, or t
  misc_feature (8)..(8): n is a, c, g, or t
  misc_feature (10)..(10): n is a, c, g, or t
  misc_feature (12)..(13): n is a, c, g, or t
  misc_feature (25)..(25): n is a, c, g, or t
nnnnnngnangnngtgatgtctaanaacgtctctatttacaagtcccaggcttctgcccttgaaaagcatgctgctgccaactgcaaggttttggttgttgctaacccagcaaacaccaatgcattgatcttgaaggaatttgctccatctattccagagaaaaacatttcttgtttgactagacttgatcacaacagggcattgggccaaatttctgaaagattgaatgttcaagtttctgatgtaaagaatgtcattatctggggtaatcattcatcaactcagtatcctgatgtcaaccatgcaactgttaacacccccgctggggagaagcctgtccgtgagcttgtttctgatgacgcctggttgaatggagaattcatatctaccgttcaacaacgtggtgctgcaattattaaggctagaaagctttcaagcgcactatccgctgctagcgctgcttgcgaccacattcgcgattgggttcttggaactccccagggcaccttcgtttcaatgggagtgtattctgatggttcttacaacgtaccagctggactcatctattcattccctgtcaccactgctaatggggaatggaaaattgttcaaggactttcaattgacgagttctcaaggaagaagttggacttgacagctgaagagttatccgaggaaaagagtttggcatact

SEQ ID NO: 252 - DNA, 1408 bp, Trifolium repens
  misc_feature (5)..(5): n is a, c, g, or t
  misc_feature (46)..(46): n is a, c, g, or t
  misc_feature (767)..(767): n is a, c, g, or t
  misc_feature (812)..(812): n is a, c, g, or t
  misc_feature (821)..(821): n is a, c, g, or t
  misc_feature (823)..(823): n is a, c, g, or t
  misc_feature (851)..(851): n is a, c, g, or t
  misc_feature (922)..(922): n is a, c, g, or t
  misc_feature (933)..(933): n is a, c, g, or t
  misc_feature (1360)..(1360): n is a, c, g, or t
  misc_feature (1386)..(1386): n is a, c, g, or t
  misc_feature (1390)..(1390): n is a, c, g, or t
  misc_feature (1393)..(1393): n is a, c, g, or t
  misc_feature (1403)..(1403): n is a, c, g, or t
aaagngaattggaatatacgacactccattccatacttccattccntactttgctttctcgctctctctctctttattctcgaaaagctttttcagccaacaacggagagaattatgaggccgtcgatgctcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttgatgtagtcagggcaaaaactttctatgccgggaaagctaaagttccagttgccgaggtcaatgtacctgttataggaggccatgcaggagttactattcttccattattttntcaggcaacacctcaagccaatctgggtgatgatacccttaaggntttaacggnanggacacaagatggaggaacagaagttgngaccgccaaggctggaaagggttctgcaactttgtcaatggcttatgctggagccatatttgctgatgctngcctcaaaggnctgaatggagttccagatgttattgagtgctcatatgtgcaatccaatatcatctctgaccttcctttctttgcttccaaggtgaggattgggaagaatggtgtggaagaaattctgggcttaggttctctcacagatttcgagcaacaaggccttgaaaacctcaaggctgaactcaaatcatctattgaaaagggaatcaaatttgcctcccagtaatcgaacatgtcatacattactggatttttccatttagaaccagatcaaattttgcaaattcagaacaattgtttgtaatgttgccggtaggtatacccctagatttaataagtaaatctgcgagagcagtttattgctgcagggactgaaattaaaaccagttttaggttggcctttccattcgtaatggcccttcattgttgcatgntttcatataatgcaattgaagggtgntggncancgatacacanccccc

SEQ ID NO: 253 - protein, 345 aa, Trifolium repens
  misc_feature (218)..(218): Xaa can be any naturally occurring amino acid
  misc_feature (233)..(233): Xaa can be any naturally occurring amino acid
  misc_feature (236)..(237): Xaa can be any naturally occurring amino acid
  misc_feature (246)..(246): Xaa can be any naturally occurring amino acid
  misc_feature (270)..(270): Xaa can be any naturally occurring amino acid
  misc_feature (273)..(273): Xaa can be any naturally occurring amino acid
MRPSMLRSVQSAVSRASSHLTRRGYATEPVPERKVAILGAAGGIGQPLSLLMKLNPLVSTLSLYDIAGTPGVAADVSHINSRSEVTGYAGEEELGKALEGADVVIIPAGVPRKPGMTRDDLFNINAGIVKSLATAISKYCPHALVNMISNPVNSTVPIAAEVFKKAGTYDEKRLFGVTTLDVVRAKTFYAGKAKVPVAEVNVPVIGGHAGVTILPLFXQATPQANLGDDTLKXLTXXTQDGGTEVXTAKAGKGSATLSMAYAGAIFADAXLKXLNGVPDVIECSYVQSNIISDLPFFASKVRIGKNGVEEILGLGSLTDFEQQGLENLKAELKSSIEKGIKFASQ

SEQ ID NO: 254 - DNA, 537 bp, Trifolium repens
  misc_feature (5)..(5): n is a, c, g, or t
  misc_feature (16)..(16): n is a, c, g, or t
  misc_feature (31)..(31): n is a, c, g, or t
aaagngaattggaatntcgacctccattccntactttatttcattcatcgctctctctctctctctctctttattctcgaaaagcttcttcagccaacaacgagagaataatgaggccgtcgatgctcagatccgtccaatcagccgtatcccgcgcctcctctcacctaacccgccgtggctatgctaccgaaccagttccagaacgcaaggtggccattctcggtgctgccggcgggatcggacagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatg

SEQ ID NO: 255 - DNA, 608 bp, Trifolium repens
  misc_feature (4)..(4): n is a, c, g, or t
  misc_feature (17)..(17): n is a, c, g, or t
gttnattggaatatacnccactccattccatactttatttcattcatcgctctctctctctctctctttattctcgaaaagctttttcagccaacaacgagagaataatgaggccgtcgatgctcagatccgtccaatcagccgtatcccgcgcctcctctcacctaacccgccgtggctatgctaccgaaccagttccagaacgcaaggtggccattctcggtgctgccggcgggatcggacagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcaggg

SEQ ID NO: 256 - DNA, 575 bp, Trifolium repens
  misc_feature (2)..(3): n is a, c, g, or t
  misc_feature (33)..(33): n is a, c, g, or t
gnncatcgacactcccttccctactttcctttntttatcgctctctctctttttattctcgaaaagctttttcagccatcaacggagagaattatgagtccgtcgatgctcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatctttttaatattaatgctggcattgtcaagtcacttgccactgctatttctaagtactgcccccatgcccttgttaacatgataagcaaccctgtgaactccaccgttcccattgctgcagg

SEQ ID NO: 257 - DNA, 563 bp, Trifolium repens
  misc_feature (2)..(2): n is a, c, g, or t
  misc_feature (13)..(13): n is a, c, g, or t
  misc_feature (20)..(20): n is a, c, g, or t
  misc_feature (24)..(24): n is a, c, g, or t
  misc_feature (27)..(27): n is a, c, g, or t
gnactccattccntactttntttnttntcgctctctctctctattctcgaaaagctttttcagccacaacgagagaataatgaggccgtcgatgctcagatctgtccaatcagccgtatcccgcgcctcctctcacctaacccgccgtggctatgctaccgaaccagttccagaacgcaaggtggccattctcggtgctgccggcgggatcggacagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagagg

SEQ ID NO: 258 - DNA, 583 bp, Trifolium repens
  misc_feature (11)..(11): n is a, c, g, or t
  misc_feature (18)..(18): n is a, c, g, or t
  misc_feature (22)..(22): n is a, c, g, or t
gcatccttccntactttnttcntcgctctctctctttattctcgaaaagctttttcagccaacaacggagagaattatgaggccgtcgatgttcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatat

SEQ ID NO: 259 - DNA, 598 bp, Trifolium repens
  misc_feature (2)..(2): n is a, c, g, or t
  misc_feature (11)..(11): n is a, c, g, or t
  misc_feature (18)..(18): n is a, c, g, or t
  misc_feature (22)..(22): n is a, c, g, or t
cntccatcccntactttnttcntcgctctctctctttattctcgaaaagctttttagccaacaacggagagaattatgaggccgtcgatgttcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgt

SEQ ID NO: 260 - DNA, 827 bp, Trifolium repens
  misc_feature (2)..(2): n is a, c, g, or t
  misc_feature (718)..(718): n is a, c, g, or t
  misc_feature (731)..(731): n is a, c, g, or t
  misc_feature (744)..(744): n is a, c, g, or t
  misc_feature (753)..(753): n is a, c, g, or t
  misc_feature (757)..(757): n is a, c, g, or t
  misc_feature (771)..(771): n is a, c, g, or t
  misc_feature (775)..(775): n is a, c, g, or t
  misc_feature (784)..(784): n is a, c, g, or t
  misc_feature (786)..(786): n is a, c, g, or t
  misc_feature (791)..(791): n is a, c, g, or t
  misc_feature (806)..(806): n is a, c, g, or t
  misc_feature (813)..(813): n is a, c, g, or t
gnttccttccctactttcattccatcgctctctctctttattctcgaaaagctttttcagccaacaacggagagaattatgaggccgtcgatgttcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttgatgtagtcagggcgaaaactttttatgccgggaaagctaaagttccagttgccgaggtcaatgtacctgtttttggaggccatgcaggagttactattnttccattattttntaaggaacacctnaagccaatntggntgatgaaacccttnaggntttaacggnangggcncaagatgggggaacngaattgngaccgccaagggtt

SEQ ID NO: 261 - DNA, 556 bp, Trifolium repens
  misc_feature (10)..(10): n is a, c, g, or t
  misc_feature (17)..(17): n is a, c, g, or t
  misc_feature (24)..(24): n is a, c, g, or t
tcccattccntactttntttattntcgctctctctctttattctcgaaaagctttttcagccaacaacgagagaataatgaggccgtcgatgctcagatccgtccaatcagccgtatcccgcgcctcctctcacctaacccgccgtggctatgctaccgaaccagttccagaacgcagggtggccattctcggtgctgctggcgggatcggacagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgc

SEQ ID NO: 262 - DNA, 682 bp, Trifolium repens
  misc_feature (9)..(9): n is a, c, g, or t
  misc_feature (20)..(20): n is a, c, g, or t
  misc_feature (56)..(56): n is a, c, g, or t
tccattccntactctatttntcgctctctctctttatattctcgaaaagctttttngccatcaacggagagaattatgaggccgtcgatgttcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatcttttcaatattaacgctggcattgttaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttgatgtagtcagggcgaaaactttctatgccgggaaagctaaagttccagttgccgaggtcaatgtac

SEQ ID NO: 263 - DNA, 801 bp, Trifolium repens
  misc_feature (178)..(178): n is a, c, g, or t
  misc_feature (553)..(553): n is a, c, g, or t
  misc_feature (572)..(572): n is a, c, g, or t
  misc_feature (585)..(585): n is a, c, g, or t
  misc_feature (590)..(590): n is a, c, g, or t
  misc_feature (669)..(669): n is a, c, g, or t
  misc_feature (673)..(673): n is a, c, g, or t
  misc_feature (678)..(679): n is a, c, g, or t
  misc_feature (686)..(686): n is a, c, g, or t
  misc_feature (699)..(699): n is a, c, g, or t
  misc_feature (704)..(704): n is a, c, g, or t
  misc_feature (710)..(710): n is a, c, g, or t
  misc_feature (730)..(731): n is a, c, g, or t
  misc_feature (735)..(735): n is a, c, g, or t
  misc_feature (737)..(737): n is a, c, g, or t
  misc_feature (741)..(741): n is a, c, g, or t
  misc_feature (744)..(744): n is a, c, g, or t
  misc_feature (747)..(747): n is a, c, g, or t
  misc_feature (751)..(751): n is a, c, g, or t
  misc_feature (772)..(773): n is a, c, g, or t
  misc_feature (777)..(777): n is a, c, g, or t
  misc_feature (783)..(783): n is a, c, g, or t
  misc_feature (795)..(795): n is a, c, g, or t
  misc_feature (798)..(798): n is a, c, g, or t
tccttccatactttcattcatcgctctctctctttattctcgaaaagctttttcagccaacaacggagagaattatgaggccgtcgatgttcagatccgtccaatcagccgtctcccgcgcctcttctcacctaacccgccgtggctatgctaccgaaccagttccagaacgcaaggnggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatcttttcaatattaacgctggcattgtcaagtcacttgccactggtatttctaagtactgcccccatgcccttgttaacatgataagcaaccctgtgaactccaccgttcccattgctgnagaggttttcaagaaggcngggacatatgacnagaanaaattgtttggggttcaacccttgatgtagtcagggggaaaactttttttgccgggaaagctaaagttccagttgccgngggnaatgnncctgttnttggaggcctgcngagtnctattntcccttttttttttaggcanncctnanccanttnggngatnaaaccttaagggtttacgggnnggcncaaaanggggaacaaaanttngac

SEQ ID NO: 264 - DNA, 577 bp, Trifolium repens
  misc_feature (2)..(3): n is a, c, g, or t
  misc_feature (19)..(19): n is a, c, g, or t
gnntctcgaaagctttttngcctaacggagagaattatgaggccgtcgatgttcagatccgtccaatcagccgtctcccgcgcctcttctcacctaacccgccgtggctatgctaccgaaccagttccagaacgcaaggtggccattctcggcgctgccggcgggatcggccagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgccggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttg

SEQ ID NO: 265 - DNA, 594 bp, Trifolium repens
ttctcaaaaagctttttagccacaacgagagaaaatgaggccgtcgatgctcagatctgtccatcagccgtatcccgcgcctcctctcacctaacccgccgtgggtatgctaccgaaccagttccagaacgcaaggtggccattctcggcgctgctggcgggatcggccagcctctctctcttctcatgaagctcaatcctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttgatgtagtcagggcaaaaact

SEQ ID NO: 266 - DNA, 811 bp, Trifolium repens
  misc_feature (28)..(28): n is a, c, g, or t
  misc_feature (30)..(30): n is a, c, g, or t
  misc_feature (140)..(140): n is a, c, g, or t
  misc_feature (517)..(517): n is a, c, g, or t
  misc_feature (547)..(547): n is a, c, g, or t
  misc_feature (584)..(584): n is a, c, g, or t
  misc_feature (635)..(635): n is a, c, g, or t
  misc_feature (678)..(678): n is a, c, g, or t
  misc_feature (689)..(689): n is a, c, g, or t
  misc_feature (691)..(691): n is a, c, g, or t
  misc_feature (703)..(703): n is a, c, g, or t
  misc_feature (712)..(712): n is a, c, g, or t
  misc_feature (720)..(720): n is a, c, g, or t
  misc_feature (724)..(724): n is a, c, g, or t
  misc_feature (734)..(734): n is a, c, g, or t
  misc_feature (743)..(743): n is a, c, g, or t
  misc_feature (745)..(745): n is a, c, g, or t
  misc_feature (754)..(754): n is a, c, g, or t
  misc_feature (756)..(756): n is a, c, g, or t
  misc_feature (766)..(766): n is a, c, g, or t
  misc_feature (769)..(769): n is a, c, g, or t
  misc_feature (772)..(773): n is a, c, g, or t
  misc_feature (782)..(782): n is a, c, g, or t
  misc_feature (795)..(795): n is a, c, g, or t
  misc_feature (797)..(798): n is a, c, g, or t
  misc_feature (804)..(805): n is a, c, g, or t
  misc_feature (811)..(811): n is a, c, g, or t
ttctcgaaagctttttcagccacaacgnanagaataatgaggccgtcgatgctcagatctgtccaatcagccgtatcccgggcctcctctcacctaacccgccgtgggtatgctaccgaaccagttccagaacgcaaggnggccattctcggtgctgccggcgggatcggacagcctctctctcttctcatgaagctcaaccctctcgtttcaaccctatctctttatgatattgctggaacccctggtgtcgccgctgatgtcagccacatcaactccagatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcanaggttttcaagaaggcagggacatatgacnagaagagattgtttggggttacaacccttgatgtagncagggcaaaaactttttatgctgggaaagctaaagttccagttgccgaggncaatggacctgttataggaggccatgcaggagttactattctnccattattttntnaggcaacacctnaagccaatntgggtgangatncccttaaggntttaacggnanggacccaananggaggaacanaanttnngacccccanggtggaagggttntnnactttnnaatggn

SEQ ID NO: 267 - DNA, 722 bp, Trifolium repens
  misc_feature (2)..(2): n is a, c, g, or t
  misc_feature (15)..(16): n is a, c, g, or t
  misc_feature (36)..(36): n is a, c, g, or t
  misc_feature (38)..(38): n is a, c, g, or t
  misc_feature (673)..(673): n is a, c, g, or t
  misc_feature (705)..(705): n is a, c, g, or t
  misc_feature (719)..(719): n is a, c, g, or t
gngtgtcgccgctgnngtcagccacatcaactccananctgagtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttgatgtagtcagggcaaaaactttctatgctgggaaagctaaagttccagttgccgaggtcaatgtacctgttataggaggccatgcaggagttactattctcccattattttctcaggcaacacctcaagccaatctggatgatgataccattaaggctctaacggcaaggacacaagatggaggaacagaagttgtgaccgccaaggctggaaagggttctgcaactttgtcaatggcttatgctggagccatatttgctgatgcttgcctcaaaggtctgaatggagttccagatgttattgagtgctcatatgtgcaatccaatatcatctctgaccttnctttctttgcttccaaggtgaggattgggaanaatggtgtgggaanaat

SEQ ID NO: 268 - DNA, 557 bp, Trifolium repens
  misc_feature (2)..(2): n is a, c, g, or t
  misc_feature (9)..(9): n is a, c, g, or t
gntgatgtngcccataactccgatctgaggtaactgggtatgcaggtgaagaagagcttggaaaagctttggagggtgctgatgttgttataattcctgctggtgtgcccagaaagcctggaatgactcgtgatgatcttttcaatattaacgctggcattgtcaagtcacttgccactgctatttctaagtactgcccccatgcccttgttaacatgataagcaaccctgtgaactccaccgttcccattgctgcagaggttttcaagaaggcagggacatatgacgagaagagattgtttggggttacaacccttgatgtagtcagggcaaaaactttctatgctgggaaagctaaagttccagttgccgaggtcaatgtacctgttataggaggccatgcaggagttactattctcccattattttctcaggcaacacctcaagccaatctggatgatgataccattaaggctctaacggcaaggacacaagatggaggaacagaagttgtgaccgccaaggctggaaagggttctgcaactttgtcaatggct

SEQ ID NO: 269 - DNA, 138 bp, Trifolium repens
  misc_feature (7)..(7): n is a, c, g, or t
  misc_feature (12)..(12): n is a, c, g, or t
  misc_feature (17)..(17): n is a, c, g, or t
  misc_feature (19)..(19): n is a, c, g, or t
  misc_feature (22)..(22): n is a, c, g, or t
  misc_feature (36)..(36): n is a, c, g, or t
  misc_feature (39)..(39): n is a, c, g, or t
  misc_feature (77)..(77): n is a, c, g, or t
  misc_feature (104)..(106): n is a, c, g, or t
ttgctgntgctngcctnanggnctgaatggagttcngangttattgaactctcatatgtgcaatccaatatcatctntgaccttcctttctttgcttccaaggnnnggattgggaagaatggtgtggaagagattctg

SEQ ID NO: 270 - DNA, 465 bp, Trifolium repens
  misc_feature (2)..(2): n is a, c, g, or t
  misc_feature (4)..(4): n is a, c, g, or t
  misc_feature (19)..(19): n is a, c, g, or t
  misc_feature (27)..(27): n is a, c, g, or t
  misc_feature (38)..(38): n is a, c, g, or t
  misc_feature (43)..(43): n is a, c, g, or t
  misc_feature (417)..(417): n is a, c, g, or t
  misc_feature (443)..(443): n is a, c, g, or t
  misc_feature (447)..(447): n is a, c, g, or t
  misc_feature (450)..(450): n is a, c, g, or t
  misc_feature (460)..(460): n is a, c, g, or t
gngngttccagatgttatngagtgctntatgtgcatcnatatntctctgaccttcctttctttgcttccaggtgaggattgggaagaatggtgtggaagaaattctgggcttaggttctctcacagatttcgagcaacaaggccttgaaaacctcaaggctgaactcaaatcatctattgaaaagggaatcaaatttgcctcccagtaatcgaacatgtcatacattactggatttttccatttagaaccagatcaaattttgcaaattcagaacaattgtttgtaatgttgccggtaggtatacccctagatttaataagtaaatctgcgagagcagtttattgctgcagggactgaaattaaaaccagttttaggttggcctttccattcgtaatggcccttcattgttgcatgntttcatataatgcaattgaagggtgntggncancgatacacanccccc

SEQ ID NO: 271 - DNA, 598 bp, Trifolium repens
  misc_feature (17)..(17): n is a, c, g, or t
gggtaggcggagatttnaacccattttcctcttaaatctctctcaacttctctttccattcccattaccattcattcccagaggtcgagatggcagcatcagcagcagctacttttactattggaactgcccaaacagggaggccacttcctcaatcaaacccttttggtttgaaagtcaattcccaggttaattttaagaccttctctggtctcaaggccatgtcatctctaagatgcgagtctgaatcatctttctttggcaacgaaactagtgctgctctgcgtgcaacttttgcacccaaagctcaaaaggaaaaccaaaacatcaaccgcaatttgcatcctcaggcatcctacaaagtggcggttcttggtgctgcaggaggaattggtcagccactggcacttctcattaagatgtcgcctttggtttccgacctgcatctttatgatatcgcgaatgttaagggagttgctgctgatatcagtcattgcaacactccttcaaaggttttggatttcacaggtgcttctgagttggcaaattgtttgaaaggtgtggatgtagttgttatacctgctggtgttcccagaaa

SEQ ID NO: 272 - protein, 169 aa, Trifolium repens
MAASAAATFTIGTAQTGRPLPQSNPFGLKVNSQVNFKTFSGLKAMSSLRCESESSFFGNETSAALRATFAPKAQKENQNINRNLHPQASYKVAVLGAAGGIGQPLALLIKMSPLVSDLHLYDIANVKGVAADISHCNTPSKVLDFTGASELANCLKGVDVVVIPAGVPR

SEQ ID NO: 273 - DNA, 554 bp, Trifolium repens
  misc_feature (2)..(2): n is a, c, g, or t
  misc_feature (17)..(17): n is a, c, g, or t
  misc_feature (44)..(44): n is a, c, g, or t
gngtaggcggagatttnaacccattttcctcttaaatctctctnaacttctctttccattcccattaccattcattcccagaggtcgagatggcagcatcagcagcagctacttttactattggaactgcccaaacagggaggccacttcctcaatcaaacccttttggtttgaaagtcaattcccaggttaattttaagaccttctctggtctcaaggccatgtcatctctaagatgcgagtctgaatcatctttctttggcaacgaaactagtgctgctctgcgtgcaacttttgcacccaaagctcaaaaggaaaaccaaaacatcaaccgcaatttgcatcctcaggcatcctacaaagtggcggttcttggtgctgcaggaggaattggtcagccactggcacttctcattaagatgtcgcctttggtttccgacctgcatctttatgatatcgcgaatgttaagggagttgctgctgatatcagtcattgcaacactccttcaaaggttttggatttcacaggtgcttctgagttggcaaattgtttg

SEQ ID NO: 274 - DNA, 593 bp, Trifolium repens
  misc_feature (15)..(16): n is a, c, g, or t
gttaggcggagattnnaacccattttcctcttaaatctctctcacttctctttccattcccattaccattcattcccagaggtcgagatggcagcatcagcagcagctacttttactattggaactgcccaaacagggaggccacttcctcaatcaaacccttttggtttgaaagtcaattcccaggttaattttaagaccttctctggtctcaaggccatgtcatctctaagatgcgagtctgaatcatctttctttggcaacgaaactagtgctgctctgcgtgcaacttttgcacccaaagctcaaaaggaaaaccaaaacatcaaccgcaatttgcatcctcaggcatcctacaaagtggcggttcttggtgctgcaggaggaattggtcagccactggcacttctcattaagatgtcgcctttggtttccgacctgcatctttatgatatcgcgaatgttaagggagttgctgctgatatcagtcattgcaacactccttcaaaggttttggatttcacaggtgcttctgagttggcaaattgtttgaaaggtgtggatgtagttgttatacctgctggtgttcccag

SEQ ID NO: 275 - DNA, 590 bp, Trifolium repens
  misc_feature (10)..(10): n is a, c, g, or t
gggagatttnaacccattttcctcttaaatctctcccacttctccttccattcccattaccattcattcccagacgttgagatggcagcatcagcagcagctacttttactattggaactgcccaaacagggaggtcacttcctcaatcaaacccttttggtttgaaagtcaattcccaggttaattttaagaccttctctggtctcaaggccatgtcgtctctaagatgcgagtctgaatcatctttctttggcaacgaaacttgtgctgctctgcgtgcaacttttgcacccaaagctcaaaaggaaaaccgaaacatcaaccgcaatttgcagcctcaggcatcctacaaagtggcggttctcggtgctgcaggaggaattggtcagccacttgcacttctcattaagatgtcgcctttggtttccgacctgcatctttatgacattgcgaatgttaagggagttgctgctgatatcagccattgcaacactccttcaaaggttttggatttcacaggtgcttctgagctagcaaattgtttgaaaggtgtggatgttgttgttatacctgctggtgttcctagaaa

SEQ ID NO: 276 - DNA, 1230 bp, Trifolium repens
  misc_feature (3)..(3): n is a, c, g, or t
  misc_feature (5)..(5): n is a, c, g, or t
  misc_feature (23)..(23): n is a, c, g, or t
  misc_feature (43)..(43): n is a, c, g, or t
  misc_feature (48)..(48): n is a, c, g, or t
  misc_feature (834)..(834): n is a, c, g, or t
  misc_feature (846)..(846): n is a, c, g, or t
  misc_feature (898)..(898): n is a, c, g, or t
  misc_feature (900)..(900): n is a, c, g, or t
  misc_feature (1162)..(1162): n is a, c, g, or t
  misc_feature (1192)..(1192): n is a, c, g, or t
ttntntttattttatgttttttncctcctacatataactcttnacttngcatacactgtgtctctcaattattattagtccttagaaatggaagcacatgcagctggagccaatcagaggattgcaagaatctctgctcatcttcaacctccaaatttccaggaaggaggtgatgttgcaattagcaaagctaactgcagagcaaaaggtggggcgccgggattcaaagtagcaatcttgggggctgctggtggaattggtcaatccctttctttgctgttgaagatcaatccattggtttcagttcttcatctttatgatgttgtcaacactcctggtgtcactgctgatgttagtcacattgacaccggtgctgtggttcgtggctttctagggcaggcacaacttgagaatgcacttacaggcatggacttggtcgttatacctgctggtgtgccgaggaaacctggaatgacaagggatgacttatttaagataaatgctggaattgtgaggactcttagcgaaggaattgccaagagctgtcctaatgcaattgtcaacttgattagcaatccagtgaattccactgtgccaattgctgctgaggttttcaagaaagccggtacatatgatccaaagcgacttttaggggttacaaccctcgatgttgtgagggcaaatacctttgtggcagaagtacttggtgttgatccaagagaggttgatgttccagtggtaggagggcacgcaggagtcacaatattacctcttttgtcacaggttaagcctcccagtagcttcaccgcagaagaaaccgaatacctgacaaancgcattcaaaanggcggaacacaagttgttgaggcaaaggctggggctggttcggcaacactantnatggcctatgcagctgccaagtttgctaacgcatgcctccgtggcttgaaaggagaagccgggatagtggagtgtgcttttgttgattctcaggttacggaacttcctttctttgcagccaaggttcgtcttggtcgcggtggagcagaagagatatatcaacttggtccccttaatgagtatgagaggattggattagaaaaagcgaagaaagagttagcaggaagcatccagaagggagtagaattcatcaaaaaaaaanaaagataaggaaaaattagttttgtattgnctctttctatatctataaagaacttgtgtaataattcc

SEQ ID NO: 277 - protein, 359 aa, Trifolium repens
  misc_feature (249)..(249): Xaa can be any naturally occurring amino acid
  misc_feature (253)..(253): Xaa can be any naturally occurring amino acid
  misc_feature (358)..(358): Xaa can be any naturally occurring amino acid
MEAHAAGANQRIARISAHLQPPNFQEGGDVAISKANCRAKGGAPGFKVAILGAAGGIGQSLSLLLKINPLVSVLHLYDVVNTPGVTADVSHIDTGAVVRGFLGQAQLENALTGMDLVVIPAGVPRKPGMTRDDLFKINAGIVRTLSEGIAKSCPNAIVNLISNPVNSTVPIAAEVFKKAGTYDPKRLLGVTTLDVVRANTFVAEVLGVDPREVDVPVVGGHAGVTILPLLSQVKPPSSFTAEETEYLTXRIQXGGTQVVEAKAGAGSATLMAYAAAKFANACLRGLKGEAGIVECAFVDSQVTELPFFAAKVRLGRGGAEEIYQLGPLNEYERIGLEKAKKELAGSIQKGVEFIKKKXR

SEQ ID NO: 278 - DNA, 673 bp, Trifolium repens
  misc_feature (3)..(3): n is a, c, g, or t
  misc_feature (5)..(5): n is a, c, g, or t
  misc_feature (23)..(23): n is a, c, g, or t
  misc_feature (43)..(43): n is a, c, g, or t
  misc_feature (48)..(48): n is a, c, g, or t
  misc_feature (651)..(651): n is a, c, g, or t
  misc_feature (670)..(670): n is a, c, g, or t
ttntntttattttatgttttttncctcctacatataactcttnacttngcatacactctgtctctaattattattagtccttcgaaatggaagcacatgcagctggtaccaatcagaggattgcaagaatctctgctcatcttcagcctccaaatttccaggaaggaggtgatgttgcaattagcaaagctaactgcagagcaaaaggtggggcgccgggattcaaagtagcaatcttgggggctgctggtggaattggtcaatccctttctttgctgttgaagatcaatccattggtttcagttcttcatctttatgatgttgtcaacactcctggtgtcactgctgatgttagtcacattgacaccggtgctgtggttcgtggctttctagggcaggcacaacttgagaatgcacttacaggcatggacttggtcgttatacctgctggtgtgccgaggaaacctggaatgacaagggatgacttatttaagataaatgctggaattgtgaggactcttagcgaaggaattgccaagagctgtcctaatgcaattgtcaacttgattagcaatccagtgaattccactgtgccaattgctgctgaggttttcaagaaagccggtacatatgatccaaagcgacttttangggtaacaaccctcgatgntgt

SEQ ID NO: 279 - DNA, 574 bp, Trifolium repens
  misc_feature (2)..(2): n is a, c, g, or t
gngtctctcaattattattagtccttagaaatggaagcacatgcagctggtgccaatcagaggattgcaagaatctctgctcatcttcaacctccaaatttccaggaaggaggtgatgttgcaattagcaaagctaactgcagagcaaaaggtggggcgccgggattcaaagtagcaatcttgggggctgctggtggaattggtcaatccctttctttgctgttgaagatcaatccattggtttcagttcttcatctttatgatgttgtcaacactcctggtgtcactgctgatgttagtcacattgacaccggtgctgtggttcgtggctttctagggcaggcacaacttgagaatgcacttacaggcatggacttggtcgttatacctgctggtgtgccgaggaaacctggaatgacaagggatgacttatttaagataaatgctggaattgtgaggactcttagcgaaggaattgccaagagctgtcctaatgcaattgtcaacttgattagcaatccagtgaattccactgtgccaattgctgctgaggttttcaagaaagccggtacat

SEQ ID NO: 280 - DNA, 543 bp, Trifolium repens
gtgtctctcaattattattagtccttagaaatggaagcccatgcagctggagccaatcagaggattgcaagaatctctgctcatcttcaacctccaaatttccaggaaggaggtgatgttgcaattagcaaagctaactgcagagcgaaaggtggggcgccgggattcaaagtagcaatcttgggggctgctggtggaattggtcaatccctttctttgctgttgaagatcaatccattggtttcagttcttcatctttatgatgttgtcaacactcctggtgtcactgctgatgttagtcacattgataccggtgctgtggttcgtggctttctagggcaggcacaacttgagaatgcacttacaggcatggacttggtcgttatacctgctggtgtgccgaggaaacctggaatgacaagggatgacttatttaagataaatgctggaattgtgaggactctttctgaaggaattgtcaagagctgtcctaatgcaattgtcaacttgattagcaatccagtgaattccactgtgccaatt

SEQ ID NO: 281 - DNA, 593 bp, Trifolium repens
  misc_feature (2)..(2): n is a, c, g, or t
  misc_feature (11)..(11): n is a, c, g, or t
gnagtccttanaaatggaagcacatgcagctggagccatcgaggattgcaagaatctctgctcatcttcgcctccaaatttccaggaaggaagtgatgtcgcaattagcaaagctaactgcagagcaaaaggtggggcgccgggattcaaagtagcaatcttgggggctgctggtggaattggtcaatccctttctttgctgttgaagatcaatccattggtttcggttcttcatctttatgatgttgtcaacactcctggtgtcactgctgatgttagtcacattgacaccggtgctgtggttcgtggctttctagggcaggcacaacttgagaatgcacttacaggcatggacttggccgttatacctgctggtgtgccgaggaaacctggaatgacaagggatgacttatttaagataaatgctggaattgtgaggactctttctgaaggaattgtcaagagctgtcctaatgcaattgtcaacttgattagcaatccagtgaattccactgtgccaattgctgctgaggtcttcaagaaagccggtacatatgatccaaaacgacttttaggagttacaaccctcgatg

SEQ ID NO: 282 - DNA, 693 bp, Trifolium repens
  misc_feature (545)..(545): n is a, c, g, or t
  misc_feature (562)..(562): n is a, c, g, or t
  misc_feature (584)..(584): n is a, c, g, or t
  misc_feature (592)..(592): n is a, c, g, or t
  misc_feature (615)..(615): n is a, c, g, or t
  misc_feature (619)..(619): n is a, c, g, or t
  misc_feature (625)..(625): n is a, c, g, or t
  misc_feature (631)..(631): n is a, c, g, or t
  misc_feature (638)..(638): n is a, c, g, or t
  misc_feature (644)..(644): n is a, c, g, or t
  misc_feature (647)..(647): n is a, c, g, or t
  misc_feature (653)..(653): n is a, c, g, or t
  misc_feature (670)..(670): n is a, c, g, or t
  misc_feature (674)..(674): n is a, c, g, or t
  misc_feature (680)..(680): n is a, c, g, or t
gagaaatggaagcacatgcagctggagccaatcagaggattgcaagaatctctgctcatcttcaacctccaaatttccaggaaggaggtgatgttgcaattagcaaagctaactgcagagcaaaaggtggggcgccgggattcaaagtagcaatcttgggggctgctggtggaattggtcaatccctttctttgctgttgaagatcaatccattggtttcggttcttcatctttatgatgttgtcaacactcctggtgtcactgctgatgttagtcacattgacaccggtgctgtggttcgtggctttctagggcaggcacaacttgagaatgcacttacaggcatggacttggtcgttatacctgctggtgtgccgaggaaacctggaatgacaagggatgacttatttaagataaatgctggaattgtgaggactctttctgaaggaattgtcaagagctgtcctaatgcaattgtcaacttgattagcaatccagtgaattccactgtgccaattgctggtgaggtcttcaagaaagccggnacatatgatccaaaacnacttttaagggttacaaccctngatgttgngagggcaaatacttttgtggcanaagncttggngttgancccaaanagggtnatnttccantggtaggagggcccccnggantacaanattaccctttttt

SEQ ID NO: 283 - DNA, 555 bp, Trifolium repens
  misc_feature (4)..(4): n is a, c, g, or t
  misc_feature (19)..(19): n is a, c, g, or t
  misc_feature (21)..(22): n is a, c, g, or t
  misc_feature (50)..(50): n is a, c, g, or t
ccantgcagctggtgccantnngaggattgcagaatctctgctcatcttnacctccaatttccaggaaggaggtgatgttgcaattagcaaagctaactgcagagcaaaaggtggggcgccgggattcaaagtagcaatcttgggggctgctggtggaattggtcaatccctttctttgctgttgaagatcaatccattggtttcagttcttcatctttatgatgttgtcaacactcctggtgtcactgctgatgttagtcacattgacaccggtgctgtggttcgtggctttctagggcaggcacaacttgagaatgcacttacaggcatggacttggtcgttatacctgctggtgtgccgaggaaacctggaatgacaagggatgacttatttaagataaatgctggaattgtgaggactcttagcgaaggaattgccaagagctgtcctaatgcaattgtcaacttgattagcaatccagtgaattccactgtgccaattgctgctgaggttttcaagaaagccggtacatatgatccaaagcgacttttag

SEQ ID NO: 284 - DNA, 473 bp, Trifolium repens
  misc_feature (42)..(42): n is a, c, g, or t
  misc_feature (339)..(339): n is a, c, g, or t
  misc_feature (356)..(356): n is a, c, g, or t
  misc_feature (394)..(394): n is a, c, g, or t
  misc_feature (401)..(401): n is a, c, g, or t
  misc_feature (409)..(409): n is a, c, g, or t
  misc_feature (414)..(414): n is a, c, g, or t
  misc_feature (432)..(432): n is a, c, g, or t
  misc_feature (434)..(434): n is a, c, g, or t
  misc_feature (437)..(437): n is a, c, g, or t
  misc_feature (446)..(446): n is a, c, g, or t
gtttcaacttgaaaatgcacttacaggcatggacttggtcgntatacctgctggtgtgccgaggaaacctggaatgacaagggatgacttatttaagataaatgctggaattgtgaggactcttagcgaaggaattgccaagagctgtcctaatgcaattgtcaacttgattagcaatccagtgaattccactgtgccaattgctgctgaggttttcaagaaagccggtacatatgattcaaagcgacttttaggggtaacaaccctcgatgttgtgagggcaaatacctttgtggcagaagtacttggtgttgatccaagagaggttgatgttccagnggtaggatggcacgcangagtacaatattacctcttttgtcacaggttaagcctnccagtancttaccgnagaanaaaccgaatacctgacanancgnattcaaaanggcggaacacaagtcgttgaggcaaag

SEQ ID NO: 285 - DNA, 598 bp, Trifolium repens
  misc_feature (266)..(266): n is a, c, g, or t
  misc_feature (560)..(560): n is a, c, g, or t
tatgatccacgcgacttttaggggtacaaccctcgatgttgtgagggcaaatacctttgtggcagaagtacttggtgttgatccaagagaggttgatgttccagtggtaggagggcacgcaggagtcacaatattacctcttttgtcacaggttaagcctcccagtagcttcactgcagaagaaaccgaatacctgacaaatcgcattcaaaatggtggaacagaagttgttgaggcaaaggctggggctggttcggcaacactantaatggcatatgcagctgccaagtttgctaacgcatgcctccgtggcttgaaaggagaagccgggatagtggagtgtgcttttgttgattctcaggttacggaacttcctttctttgcagccaaggttcgtcttggtcgcggtggagcagaagagatataccaacttggtccccttaatgagtatgagaggattgggttggaaaaagcgaagaatgagttagcgggaagcatccagaagggagtagaattcatcagaaaataagtcagataaggaaaaattagttttgtattgnctctttctatatctataaagaacttgtgtaataattcc

SEQ ID NO: 286 - DNA, 306 bp, Trifolium repens
  misc_feature (40)..(40): n is a, c, g, or t
  misc_feature (42)..(42): n is a, c, g, or t
  misc_feature (298)..(298): n is a, c, g, or t
  misc_feature (304)..(304): n is a, c, g, or t
gttgttgaggcaaaggctggggctggttcggcaacactantnatggcctatgcagctgccaagtttgctaacgcatgcctccgtggcttgaaaggagaagccgggatagtggagtgtgcttttgttgattctcaggttacggaacttcctttctttgcagccaaggttcgtcttggtcgcggtggagcagaagagatatatcaacttggtccccttaatgagtatgagaggattggattagaaaaagcgaagaaagagttagcaggaagcatccagaagggagtagaattcatcacanaaaaanaa

SEQ ID NO: 287 - DNA, 299 bp, Trifolium repens
  misc_feature (10)..(10): n is a, c, g, or t
  misc_feature (31)..(31): n is a, c, g, or t
  misc_feature (36)..(36): n is a, c, g, or t
  misc_feature (38)..(38): n is a, c, g, or t
  misc_feature (299)..(299): n is a, c, g, or t
ttgttgaggnaaaggctggggctggttcggnacctntnatggcctatgcagctgccagtttgctaacgcatgcctccgtggcttgaaaggagaagccgggatagtggagtgtgcttttgttgattctcaggttacggaacttcctttctttgcagccaaggttcgtcttggtcgcggtggagcagaagagatatatcaacttggtccccttaatgagtatgagaggattggattagaaaaagcgaagaaagagttagcaggaagcatccagaagggagtagaattcatcaaaaaaaaan

SEQ ID NO: 288 - DNA, 866 bp, Trifolium repens
  misc_feature (2)..(3): n is a, c, g, or t
  misc_feature (7)..(7): n is a, c, g, or t
  misc_feature (14)..(14): n is a, c, g, or t
  misc_feature (38)..(38): n is a, c, g, or t
  misc_feature (280)..(280): n is a, c, g, or t
gnntacngctatcnacccttctttcttatacaataatnatagataaattcatctgctaaattatggagccaaattcagatgcaaatcaacgaatcgcaagaatctccggccacctaaatcctcccaatttcaagatgaatgaacatggtgattcttctttgacaagtttccattgccgtgcaaaaggtggagcacctggattcaaagttgcaattttaggtgctgctggtggcataggtcaacctctttcaatgttgatgaagatgaatcctttggtttnagttcttcatctttatgatgttgttaatactcctggtgttacttctgatattagtcatatggatactgctgctgttgttcgagggtttttggggcaaaatcagcttgaggatgcacttacaggtatggatttggtaatcattcctgccggtgttccccgtaaacctggaatgacaagagatgatctcttcaatataaatgccgggatcgttaaaacactctgtgaagcaattgcaaagcgatgtcctaaggcgattgtcaacgtgattagtaatccggttaactccactgtccccattgcggctgaagttttcaaaagagccggtacttatgatcccaagagacttttgggagtgacaatgcttgatgtggttcgggccaatacgtttgtggctgaagttcttggtcttgatccaagggatgtggatgtcccagttgtcggaggacatgccggaatcaccattttacctctgctttctcaggttaaaccacattcctctttcacgacaaaggaaattgagtacttgacagatcgcatacaaaacggtggaactgaagttgttgaggccaaagctggagctggctct

SEQ ID NO: 289 - protein, 268 aa, Trifolium repens
  misc_feature (73)..(73): Xaa can be any naturally occurring amino acid
MEPNSDANQRIARISGHLNPPNFKMNEHGDSSLTSFHCRAKGGAPGFKVAILGAAGGIGQPLSMLMKMNPLVXVLHLYDVVNTPGVTSDISHMDTAAVVRGFLGQNQLEDALTGMDLVIIPAGVPRKPGMTRDDLFNINAGIVKTLCEAIAKRCPKAIVNVISNPVNSTVPIAAEVFKRAGTYDPKRLLGVTMLDVVRANTFVAEVLGLDPRDVDVPVVGGHAGITILPLLSQVKPHSSFTTKEIEYLTDRIQNGGTEVVEAKAGAGS

SEQ ID NO: 290 - DNA, 572 bp, Trifolium repens
  misc_feature (2)..(3): n is a, c, g, or t
  misc_feature (7)..(7): n is a, c, g, or t
  misc_feature (14)..(14): n is a, c, g, or t
  misc_feature (38)..(38): n is a, c, g, or t
gnntacngctatcnacccttctttcttatacaataatnatagataaattcatctgctaaattatggagccaaattcagatgcaaatcaacgaatcgcaagaatctccggccacctaaatcctcccaatttcaagatgaatgaacatggtgattcttctttgacaagtttccattgccgtgcaaaaggtggagcacctggattcaaagttgcaattttaggtgctgctggtggcataggtcaacctctttcaatgttgatgaagatgaatcccttggtttagttcttcatctttatgatgttgttaatactcctggtgttacttctgatattagtcacatggatactggtgctgttgttcgaggatttttggggcaaaatcagcttgaggatgcacttacaggtatggatttggtaatcattcctgctggtgttccccgtaaacctggaatgacaagagatgatctcttcaatataaatgccgggatcgttaaaacactctgtgaagcaattgcgaagcgatgtcctaaggcgattgtcaacgtgattagtaatccggttaactccactgtcc

SEQ ID NO: 291 - DNA, 576 bp, Trifolium repens
  misc_feature (4)..(4): n is a, c, g, or t
  misc_feature (12)..(12): n is a, c, g, or t
  misc_feature (22)..(22): n is a, c, g, or t
gtgncataggtnaccctctttnatgttgatgaagatgaatcctatggtttagttcttcatctttatgatgttgttaatactcctggtgttacttctgatattagtcatatggatactgctgctgttgttcgagggtttttggggcaaaatcagcttgaggatgcacttacaggtatggatttggtaatcattcctgccggtgttccccgtaaacctggaatgacaagagatgatctcttcaatataaatgccgggatcgttaaaacactctgtgaagcaattgcaaagcgatgtcctaaggcgattgtcaacgtgattagtaatccggttaactccactgtccccattgcggctgaagttttcaaaagagccggtacttatgatcccaagagacttttgggagtgacaatgcttgatgtggttcgggccaatacgtttgtggctgaagttcttggtcttgatccaagggatgtggatgtcccagttgtcggaggacatgccggaatcaccattttacctctgctttctcaggttaaaccacattcctctttcacgacaaaggaaattgagtacttg

SEQ ID NO: 292 - DNA, 592 bp, Trifolium repens
  misc_feature (9)..(10): n is a, c, g, or t
  misc_feature (19)..(19): n is a, c, g, or t
tttggtttnngttcttatnctttatgatgttgtaatactcctggtgtacttctgatattagtatatggatactgctgctgttgttcgagggtttttggggcaaaatcagcttgaggatgcacttacaggtatggatttggtaatcattcctgccggtgttccccgtaaacctggaatgacaagagatgatctcttcaatataaatgccgggatcgttaaaacactctgtgaagcaattgcaaagcgatgtcctaaggcggttgtcaacgtgattagtaatccggttaactccactgtccccattgcggctgaagttttcaaaagagccggtacttatgatcccaagagacttttgggagtgacaatgcttgatgtggttcgggccaatacgtttgtggctgaagttcttggtcttgatccaagggatgtggatgtcccagttgtcggaggacatgccggaatcaccattttacctctgctttctcaggttaaaccacattcctctttcacgacaaaggaaattgagtacttgacagatcgcatacaaaacggtggaactgaagttgttgaggccaaagctggagctggctct

SEQ ID NO: 293 - DNA, 599 bp, Trifolium repens
  misc_feature (199)..(199): n is a, c, g, or t
  misc_feature (210)..(210): n is a, c, g, or t
  misc_feature (271)..(271): n is a, c, g, or t
gtaggcagcatctaacagcacaatgaacatggaaatgtttgctttggaaattatggacaatacggtccttaaaaaatctgttcttgttttattttgtacttttttgttttggaagatcgttagatacatgtgtggtcttctcaaagttgataaggaaccagtcactgtattggtcactggtgctgcaggacaaattggntatgctcttgntccaatgattgcaagagggatgatgctaggcccaaatcaacctggaattcttcatatgctngatattgaaccaggattagaggcccttaaaggggtgaagatggaactgattgatggtgctttcccacttcttagaggtgttgttgctactacggatgttgttgaagcatgcaaggatgttaacattgctgttatgcttggtggatccccaaggaaggaaggaatggaaagaaaagatgtaatgtctaagaatgtttcaatttacaaggctcaagcttcagctttggaggagcatgctgctgcagattgtaaagtgctagtggtagccaatccagcaaacacaaatgctctaatattgaaagaatttgctccatcaatccctgagaaaa

SEQ ID NO: 294 - protein, 157 aa, Trifolium repens
  misc_feature (24)..(24): Xaa can be any naturally occurring amino acid
  misc_feature (28)..(28): Xaa can be any naturally occurring amino acid
  misc_feature (48)..(48): Xaa can be any naturally occurring amino acid
MCGLLKVDKEPVTVLVTGAAGQIXYALXPMIARGMMLGPNQPGILHMXDIEPGLEALKGVKMELIDGAFPLLRGVVATTDVVEACKDVNIAVMLGGSPRKEGMERKDVMSKNVSIYKAQASALEEHAAADCKVLVVANPANTNALILKEFAPSIPEK

SEQ ID NO: 295 - DNA, 276 bp, Trifolium repens
  misc_feature (197)..(197): n is a, c, g, or t
  misc_feature (208)..(208): n is a, c, g, or t
  misc_feature (210)..(210): n is a, c, g, or t
  misc_feature (221)..(221): n is a, c, g, or t
  misc_feature (223)..(223): n is a, c, g, or t
  misc_feature (237)..(237): n is a, c, g, or t
  misc_feature (239)..(239): n is a, c, g, or t
  misc_feature (247)..(247): n is a, c, g, or t
  misc_feature (254)..(254): n is a, c, g, or t
  misc_feature (269)..(269): n is a, c, g, or t
  misc_feature (271)..(271): n is a, c, g, or t
  misc_feature (273)..(273): n is a, c, g, or t
gtaggcatcataacagcacaatgaacatggaaatgtttgctttggaaattatggacaatacggtccttaaaaaatctgttcttgttttattttgtacttttttgttttggaagatcgttagatacatgtgtggtcttctcaaagttgataaggaaccagtcactgtattggtcactggtgctgcaggacaaattggntatgctcttgntncaatgattgcnanagggatgatgctangnccaaatcnacctggnattgttgatatgctngntnttg

SEQ ID NO: 296 - DNA, 594 bp, Trifolium repens
  misc_feature (2)..(3): n is a, c, g, or t
gnnggatctaacagacaatgaacatggaaatgtttgctttggaaattatggacaatacggtccttaaaaaatctgttcttgttttattttgtacttttttgttttggaagatcgttagatacatgtgtggtcttctcaaagttgataaggaaccagtcactgtattggtcactggtgctgcaggacaaattggttatgctcttgttccaatgattgcaagagggatgatgctaggcccaaatcaacctgtaattcttcatatgcttgatattgaaccaggattagaggcccttaaaggggtgaagatggaactgattgatggtgctttcccacttcttagaggtgttgttgctactacggatgttgttgaagcatgcaaggatgttaacattgctgttatgcttggtggatccccaaggaaggaaggaatggaaagaaaagatgtaatgtctaagaatgtttcaatttacaaggctcaagcttcagctttggaggagcatgctgctgcagattgtaaagtgctagtggtagccaatccagcaaacacaaatgctctaatattgaaagaatttgctccatcaatccctgagaaaa

SEQ ID NO: 297 - DNA, 866 bp, Trifolium repens; identical to SEQ ID NO: 288
  misc_feature (2)..(3): n is a, c, g, or t
  misc_feature (7)..(7): n is a, c, g, or t
  misc_feature (14)..(14): n is a, c, g, or t
  misc_feature (38)..(38): n is a, c, g, or t
  misc_feature (280)..(280): n is a, c, g, or t

SEQ ID NO: 298 - protein, 268 aa, Trifolium repens; identical to SEQ ID NO: 289
  misc_feature (73)..(73): Xaa can be any naturally occurring amino acid

SEQ ID NO: 299 - DNA, 572 bp, Trifolium repens; identical to SEQ ID NO: 290
  misc_feature (2)..(3): n is a, c, g, or t
  misc_feature (7)..(7): n is a, c, g, or t
  misc_feature (14)..(14): n is a, c, g, or t
  misc_feature (38)..(38): n is a, c, g, or t

SEQ ID NO: 300 - DNA, 576 bp, Trifolium repens; identical to SEQ ID NO: 291
  misc_feature (4)..(4): n is a, c, g, or t
  misc_feature (12)..(12): n is a, c, g, or t
  misc_feature (22)..(22): n is a, c, g, or t

SEQ ID NO: 301 - DNA, 592 bp, Trifolium repens; identical to SEQ ID NO: 292
  misc_feature (9)..(10): n is a, c, g, or t
  misc_feature (19)..(19): n is a, c, g, or t

SEQ ID NO: 302 - DNA, 647 bp, Trifolium repens
  misc_feature (2)..(2): n is a, c, g, or t
  misc_feature (14)..(14): n is a, c, g, or t
gnaatcctctttgnctcccctaccctccttttttttccttccttcttacaccttctcttatcaactttccacctctgaacaaaacttcaatcttttctcattttcttatacccttttacaaacttcttcataaagtgttaggtttttttttattactcttttcaagaaccacaaaaacagtgtttcttgaattctttggaattttttttttcctgcaaccatggccttggcacacttaaacaaccccacttgctcaaaaactcaacttcactcatcacaactctcatttctctctaggactctccctaggcaatatcactgtacttttgcaccacttcacagaactcaacatggcagaattacttgttctgttgcaccaaatcaagtgcaggctccagctgtacaatcacaggatcccaagaataagcctgattgctatggtgtcttctgccttacctatgatttgaaggctgaagaggagacaaaatcctggaagaaattaatcaacattgcagtctcaggtgctgctggaatgatttccaatcatctacttttcaagcttgcatctggtgaagtttttggcccaaatcaacctattgcgctgaaattattaggatcagaaaggtccttccaagctcttgaaggtg

SEQ ID NO: 303 - protein, 142 aa, Trifolium repens
MALAHLNNPTCSKTQLHSSQLSFLSRTLPRQYHCTFAPLHRTQHGRITCSVAPNQVQAPAVQSQDPKNKPDCYGVFCLTYDLKAEEETKSWKKLINIAVSGAAGMISNHLLFKLASGEVFGPNQPIALKLLGSERSFQALEG

SEQ ID NO: 304 - DNA, 602 bp, Trifolium repens
  misc_feature (2)..(2): n is a, c, g, or t
  misc_feature (14)..(14): n is a, c, g, or t
gnaatcctctttgnctcccctaccctccttttttttccttccttcttacacttctcttctcaactttccacctctgaacaaaacttctatcttttctcattttcttatacccttttagaaacttcttcataaagtgttatttttttttattactcttttcaagaatcacaaaaacagtgtttcttgaattctttgtaattttttttttcctgcaaccatggccttggcacagttaaacaatcccacttgctcaaaaactcaacttcactcatcacaactctcatttttgtctaggactctccctaggcaatatcactgtacttttgcaccacttcacagaactcaacatggcagaattacttgttctgttgcaccaaatcaagtgcaggctccagctgtacaatcacaggatcccaagaataagcctgattgctatggtgtcttctgccttacctatgatttgaaggctgaagaggagacaaaatcctggaagaaattaatcaacattgcagtctcaggtgctgctggaatgatttccaatcatctacttttcaagcttgcatctggtgaagtttttggtccaaatcaacctattgcgctga

SEQ ID NO: 305 - DNA, 599 bp, Trifolium repens
  misc_feature (27)..(27): n is a, c, g, or t
ttcttagaccttctcttataactttcnacctctgaaccaaattaatcttttctattttcttatacccttttacaaacttcttcataaagtgttgggtttttttttattactcttttcaagaaccacaaaaacagtgtttcttgaattcttggaatttttttttcctgcaaccatggctttggcacacttaaacaaccccacttgctcaaaaactcaacttcattcatcacagctctcatttctctctaggactctccctaggcaatatcactgtacttttgcaccacttcacagaactcaacatggcagaattacttgttctgttgcaccaaatcaagtgcaggctccagctgtacaatcacaggatcccaagaataagcctgattgctatggtgtcttctgccttacctatgatttgaaggctgaagaggagacaaaatcctggaagaaattaatcaacattgcagtctcaggtgctgctggaatgatttccaatcatctacttttcaagcttgcatctggtgaagtttttggcccaaatcaacctattgcgctgaaattattaggatcagaaaggtccttccaagctcttgaaggtg

SEQ ID NO: 306 - DNA, 569 bp, Trifolium repens
  misc_feature (8)..(8): n is a, c, g, or t
  misc_feature (12)..(12): n is a, c, g, or t
  misc_feature (14)..(14): n is a, c, g, or t
gcaaagcnctcncngacctggtgtggagcgagcagctttgctagacataaatgggcagatttttgcggagcagggaaaagctctaaatgcagtcgcatctcgcaatgtcaaagttatagttgtgggaaacccttgcaatacaaatgcattaatatgcttgaagaatgctccaaatattcctgcaaaaaattttcatgctttaacccgtttagatgagaacagagcaaaatgtcagctagccctcaaggcaggtgtcttctacgataaagtgtcgaatatgacgatatggggaaaccactcaactactcaggtccccgatttcttaaatgccagaatcgatggtttgcctgtcaaagaagtgattaaggatcaaaagtggttagaggaagagttcaccgaaaaagttcaaaagagaggtggcgtgcttattcaaaagtggggaagatcgtctgctgcatcaacttctgtgtcgatagttgatgccatacgatctttgatcactcctactccggagggtgattggttttctactggtgtgtatacagctggaaatccttatggaatagctg

SEQ ID NO: 307 - protein, 189 aa, Trifolium repens
  misc_feature (3)..(5): Xaa can be any naturally occurring amino acid
QSXXXPGVERAALLDINGQIFAEQGKALNAVASRNVKVIVVGNPCNTNALICLKNAPNIPAKNFHALTRLDENRAKCQLALKAGVFYDKVSNMTIWGNHSTTQVPDFLNARIDGLPVKEVIKDQKWLEEEFTEKVQKRGGVLIQKWGRSSAASTSVSIVDAIRSLITPTPEGDWFSTGVYTAGNPYGIA

SEQ ID NO: 308 - DNA, 558 bp, Trifolium repens
  misc_feature (2)..(2): n is a, c, g, or t
gngtagaacccgtgaagccttttccctccggtctccccgcttgcgccgtcgccgtcaattgctgcttgtgtcgtcgcctccagctcctcctcctccactgtgccaaccgaattacaaaccaaaaaaatggcgacttgtttgcaaacacaactcctccacacaagaccttttcagtttcggtcttcctcgtcgacaagaccaacttccctaagatgttccgccgccaccccatccaccaaaaaatcctacaaaatcactcttcttccgggtgatggcataggtcctgaagtcgtttccgtcgctaaagacgttcttctcctcactggatccatccatgggattaaacttgagtttcaagagaagcttttgggtggtgctgctcttgatgctactggagttcctttacctgatgatactctttctgttgctaagcaatctgatgctgttcttcttggtgctattggagggtataaatgggataaaaatgagaaacagctgaagccagaaactggattgcttcagctacgagaagggcttcaagtttttgctaatctcaga

SEQ ID NO: 309 - protein, 144 aa, Trifolium repens
MATCLQTQLLHTRPFQFRSSSSTRPTSLRCSAATPSTKKSYKITLLPGDGIGPEVVSVAKDVLLLTGSIHGIKLEFQEKLLGGAALDATGVPLPDDTLSVAKQSDAVLLGAIGGYKWDKNEKQLKPETGLLQLREGLQVFANLR

SEQ ID NO: 310 - DNA, 713 bp, Trifolium repens
  misc_feature (2)..(3): n is a, c, g, or t
  misc_feature (9)..(9): n is a, c, g, or t
  misc_feature (663)..(663): n is a, c, g, or t
  misc_feature (713)..(713): n is a, c, g, or t
gnnacattnccgaatgctgctgaactagggagtgattcccttggagcctatgtcatctctatggcctcaagtgcaagcgatgtccttgcagtagagcttttacagaaggatgcacgtcttacagtttgtggagaattaggaagagcatgtccgggtggaacgcttcgggtggttcctctatttgaaactgtgcaagacctgagaggagctggtgcagttatcagaaaacttttatcaatcgattggtaccgccaacacatcattaagaaccataacggacaccaagaggttatggtcggttattctgattctggtaaagatgccgggcgctttactgctgcttgggaactttacaaagctcaagaggatgtagtggctgcttgcaataagtacgatactaaggttactttgttccacggccgcggagggagtattggacgtggcggaggcccaacatatctggctattcagtcccagccacctggctctgtgatgggaacccttcggtcaactgagcagggagagatggtgcaggccgagtttgggttgccacagacagcagttagacaacttgaaatatacacaacagctgtgctacttgctacacgtcgtccaccactcccacctcgagaagaaaaatggcgtaatctaatggaagacatntcaaaaatcagttgtcagtcctaccgcagtgtagtctatgaaaatccagn

SEQ ID NO: 311 - protein, 237 aa, Trifolium repens
  misc_feature (1)..(1): Xaa can be any naturally occurring amino acid
  misc_feature (3)..(3): Xaa can be any naturally occurring amino acid
  misc_feature (221)..(221): Xaa can be any naturally occurring amino acid
XTXPNAAELGSDSLGAYVISMASSASDVLAVELLQKDARLTVCGELGRACPGGTLRVVPLFETVQDLRGAGAVIRKLLSIDWYRQHIIKNHNGHQEVMVGYSDSGKDAGRFTAAWELYKAQEDVVAACNKYDTKVTLFHGRGGSIGRGGGPTYLAIQSQPPGSVMGTLRSTEQGEMVQAEFGLPQTAVRQLEIYTTAVLLATRRPPLPPREEKWRNLMEDXSKISCQSYRSVVYENP

SEQ ID NO: 312 - DNA, 576 bp, Trifolium repens
  misc_feature (2)..(3): n is a, c, g, or t
  misc_feature (9)..(9): n is a, c, g, or t
  misc_feature (575)..(576): n is a, c, g, or t
gnnacattnccgaatgctgctgaactagggagtgattcccttggagcctatgtcatctctatggcctcaagtgcaagcgatgtccttgcagtagagcttttcagaaggatgcacgacttgctgctattggagagttcggaagagcatgtcctggtggaacgttgcgggttgtccctctatttgaaactgtgaaggacctaagaggagctggttcagttatccggaaacttttatcgatagactggtaccgtgaacacatcattaagaaccacaatggacatcaagaggttatggttggatattctgattcgggtaaagatgctggccgcttcactgctgcttgggaactttacaaagctcaggaggatgttgtagctgcttgcaatgattatggtattaaagttacactgtttcatggccgtggaggcagtattggtcgaggtggtggccctacatatctggctattcagtcccaaccacctgggtctgtgatgggaacacttcggtctactgagcagggagaaatggtagaggccaagtttgggttaccacagatagctgttagacaacttgann

SEQ ID NO: 313 - DNA, 570 bp, Trifolium repens
  misc_feature (2)..(2): n is a, c, g, or t
  misc_feature (570)..(570): n is a, c, g, or t
gnacttttacagaaggatgcacgtcttacagtttgtggagaattaggaagagcatgtccgggtggaacgcttcgggtggttcctctatttgaaactgtgcaagacctgagaggagctggtgcagttatcagaaaacttttatcaatcgattggtaccgccaacacatcattaagaaccataacggacaccaagaggttatggtcggttattctgattctggtaaagatgccgggcgctttactgctgcttgggaactttacaaagctcaagaggatgtagtggctgcttgcaataagtacgatactaaggttactttgttccacggccgcggagggagtattggacgtggcggaggcccaacatatctggctattcagtcccagccacctggctctgtgatgggaacccttcggtcaactgagcagggagagatggtgcaggccgagtttgggttgccacagacagcagttagacaacttgaaatatacacaacagctgtgctacttgctacacgtcgtccaccactcccacctcgagaagaaaaatggcgtaatctaatggaagacatn

SEQ ID NO: 314 - DNA, 619 bp, Trifolium repens
  misc_feature (13)..(13): n is a, c, g, or t
  misc_feature (619)..(619): n is a, c, g, or t
agcttttacaganggatgcacgtcttacagtttgtggagaattaggaagagcatgtccgggtggaacgcttcgggtggttcctctatttgaaactgtgcaagacctgagaggagctggtgcagttatcagaaaacttttatcaatcgattggtaccgccaacacatcattaagaaccataacggacaccaagaggttatggtcggttattctgattctggtaaagatgccgggcgctttactgctgcttgggaactttacaaagctcaagaggatgtagtggctgcttgcaataagtacgatactaaggttactttgttccacggccgcggagggagtattggacgtggcggaggcccaacatatctggctattcagtcccagccacctggctctgtgatgggaacccttcggtcaactgagcagggagagatggtgcaggccgagtttgggttgccacagacagcagttagacaacttgaaatatacacaacagctgtgctacttgctacacgtcgtccaccactcccacctcgagaagaaaaatggcgtaatctaatggaagacatttcaaaaatcagttgtcagtcctaccgcagtgtagtctatgaaaatccagn

SEQ ID NO: 315 - DNA, 598 bp, Trifolium repens
  misc_feature (2)..(2): n is a, c, g, or t
gnaagggacaagctctatcgtactcgtgagcggtctcgctatctcttagctcatggctattctgaaattcctgaagaagccacattcaccgatgttgatgagttcttggaacctcttgaactatgctacagatcactctgtgcttgtggtgatcgtgcgattgccgatggaagccttcttgatttcttgaggcaagtttccacttttggactgtcactggtaagacttgatataaggcaagagtcagatcgtcacacggacgtgatggatgccattaccaaacatttggaaattggatcctaccaagactggtctgaagaaaaaagacaggaatggcttttgtctgagttggttggcaaaaggccgctttttggacctgacctacctcaaaccgatgaaattagagaagttttagagacatttcatgtcatagcagaacttccatcagacaactttggagcctatatcatttcgatggcaactgccccgtctgatgtgctagcggttgaacttcttcaacgtgaatgcaaaatcaagaatccgttaagagttgttccgttgtttgagaaacttgctgatctcgagtctgctcctgctg

SEQ ID NO: 316 - protein, 199 aa, Trifolium repens
  misc_feature (1)..(1): Xaa can be any naturally occurring amino acid
XRDKLYRTRERSRYLLAHGYSEIPEEATFTDVDEFLEPLELCYRSLCACGDRAIADGSLLDFLRQVSTFGLSLVRLDIRQESDRHTDVMDAITKHLEIGSYQDWSEEKRQEWLLSELVGKRPLFGPDLPQTDEIREVLETFHVIAELPSDNFGAYIISMATAPSDVLAVELLQRECKIKNPLRVVPLFEKLADLESAPA

SEQ ID NO: 317 - DNA, 598 bp, Trifolium repens; identical to SEQ ID NO: 315
  misc_feature (2)..(2): n is a, c, g, or t

SEQ ID NO: 318 - DNA, 584 bp, Trifolium repens
  misc_feature (584)..(584): n is a, c, g, or t
gtaagggacaagctctatcgtactcgtgagcggtctcgctatctcttagctcatggctattctgaaattcctgaagaagccacattcaccgatgttgatgagttcttggaacctcttgaactatgctacagatcactctgtgcttgtggtgatcgtgcgattgccgatggaagccttcttgatttcttgaggcaagtttccacttttggactgtcactggtaagacttgatataaggcaagagtcagatcgtcacacggacgtgatggatgccattaccaaacatttggaaattggatcctaccaagactggtctgaagaaaaaagacaggaatggcttttgtctgagttggttggcaaaaggccgctttttggacctgacctacctcaaaccgatgaaattagagaagttttagagacatttcatgtcatagcagaacttccatcagacaactttggagcctatatcatttcgatggcaactgccccgtctgatgtgctagcggttgaacttcttcaacgtgaatgcaaaatcaagaatccgttaagagttgttccgttgtttgagaaacttgctgatctcgn

SEQ ID NO: 319 - DNA, 575 bp, Trifolium repens
  misc_feature (15)..(15): n is a, c, g, or t
  misc_feature (575)..(575): n is a, c, g, or t
gtcacatgacaaacnatatctccctttctctaactccgtgatcaaggcgttagttagttacacaaattgctgttaggtttcgttgtactttcccgtgcaatccatagtatcttggaggaacaaactagattttccacctaggtcgtcacgagattttcctcttcactatttttctttttcatataataactcaacactttttctagctacttactagtactgtgtaacacaaattttattcattatggctactcctcgcaacattgaaaaaatggcttcaattgatgctcaattgagactactagcaccaaggaaagtttctgatgatgataaacttgtcgagtatgatgctttgttattggatcgattccttgacattcttcaagatttgcatggagaagatatcagacaaactgttcaagattgttatgagttatcggcagagtatgaaggggagcttaagccggagaaattggaggaacttgggaatatgcttactggtcttgatgctggagattctattgttatagcaaaatcattttctcatatgcttaatttggcaaacttggcagagn

SEQ ID NO: 320 - protein, 110 aa, Trifolium repens
MATPRNIEKMASIDAQLRLLAPRKVSDDDKLVEYDALLLDRFLDILQDLHGEDIRQTVQDCYELSAEYEGELKPEKLEELGNMLTGLDAGDSIVIAKSFSHMLNLANLAE

SEQ ID NO: 321 - DNA, 575 bp, Trifolium repens
  misc_feature (12)..(12): n is a, c, g, or t
  misc_feature (575)..(575): n is a, c, g, or t
gtcacatgactnactatatctccctttctctaactccgtgatcaaggcgttagttagttacacaaattgctgttaggtttcgttgtactttcccgtgcaatccatagtatcttggaggaacaaactagattttccacctaggtcgtcacgagattttcctcttcactatttttctttttcatataataactcaacactttttctagctacttactagtactgtgtaacacaaattttattcattatggctactcctcgcaacattgaaaaaatggcttcaattgatgctcaattgagactactagcaccaaggaaagtttctgatgatgataaacttgtcgagtatgatgctttgttattggatcgattccttgacattcttcaagatttgcatggagaagatatcagacaaactgttcaagattgttatgagttatcggcagagtatgaaggggagcttatgccggagaaattggaggaacttgggaatatgcttactggtcttgatgctggagattctattgttatagcaaaatcattttctcatatgcttaatttggcaaacttggcagagn

SEQ ID NO: 322 - DNA, 537 bp, Trifolium repens
  misc_feature (9)..(9): n is a, c, g, or t
  misc_feature (537)..(537): n is a, c, g, or t
tgacaaacnatatctccctttctctaactccgtgatcaaggcgttagttagttacacaaattgctgttaggtttcgttgtactttcccgtgcaatccatagtatcttggaggaacaaactagattttccacctaggttgtcacgagattttcctcttcactatttttctttttcatataataattcaacactttttctagctacttactagtactgtgtaacacaaattttattcattatggctactcctcgcaacattgaaaaaatggcttcaattgatgctcaattgagactactagcaccaaggaaagtttctgatgatgataaacttgtcgagtatgatgctttgttattggatcgattccttgacattcttcaagatttgcatggagaagatatcagacaaactgttcaagattgttatgagttatcggcagagtatgaaggggagcttaagccggagaaattggaggaacttgggaatatgcttactggtcttgatgctggagattctattgttatagcaaaatcattttn

SEQ ID NO: 323 - DNA, 854 bp, Trifolium repens
  misc_feature (583)..(583): n is a, c, g, or t
  misc_feature (589)..(589): n is a, c, g, or t
  misc_feature (596)..(596): n is a, c, g, or t
  misc_feature (602)..(602): n is a, c, g, or t
  misc_feature (608)..(608): n is a, c, g, or t
  misc_feature (708)..(708): n is a, c, g, or t
  misc_feature (737)..(737): n is a, c, g, or t
  misc_feature (762)..(762): n is a, c, g, or t
  misc_feature (775)..(775): n is a, c, g, or t
  misc_feature (786)..(786): n is a, c, g, or t
  misc_feature (789)..(789): n is a, c, g, or t
  misc_feature (795)..(797): n is a, c, g, or t
  misc_feature (816)..(816): n is a, c, g, or t
  misc_feature (830)..(830): n is a, c, g, or t
  misc_feature (834)..(834): n is a, c, g, or t
  misc_feature (853)..(854): n is a, c, g, or t
agaagatctcatgtttgagttgtctatgtggcgctgcaacgacgagctccgtgttagagctgaagagcttcatagatcctcaaagaaagatgcaaaacattatattgagttttggaaacagattcctccaaacgagccatatcgtgttattcttggaggtgtgagggacaaactgtataatacacgtgaacgtgctcgacagttattagcaaatggaacctctgacatccttgaagagacaaccttcacgaatgttgagcagtttctggagcctcttgaactgtgttataggtcactttgtgcatgtggtgaccgatcaatagcagacggaagccttcttgatttcttgcgacaagtttctacatttggactttcacttgtaagactcgacatccgtcaagagtcagacaggcacacagacgttatggatgcaattacaaaacacttggagattggatcttaccgagaatggtcggaagaacgcaggcaggaatggctcttgtctgagcttagtggaaaacgccctctcttcggccatgatcttcctaagacagaagaaattgccgatgttttagataccttncacgtnatttcanaacttncctcanatagctttggtgcctatatcatctcaatggcaacctccccatctgatgtgctagctgtcgagcttttacaacgtgaatgtcatgtgaagcagccgttaanagttgttccactgtttgaaaagctcgccngtcttgagtctgctcctgctgcggnagcgcgttttttnttagattgggncanaaccgnnntaatggaaagcagaagttntgataggtactcanactngggaaaagatgctggccgnn

SEQ ID NO: 324 - protein, 284 aa, Trifolium repens
  misc_feature (194)..(194): Xaa can be any naturally occurring amino acid
  misc_feature (196)..(196): Xaa can be any naturally occurring amino acid
  misc_feature (199)..(199): Xaa can be any naturally occurring amino acid
  misc_feature (201)..(201): Xaa can be any naturally occurring amino acid
  misc_feature (203)..(203): Xaa can be any naturally occurring amino acid
  misc_feature (236)..(236): Xaa can be any naturally occurring amino acid
  misc_feature (246)..(246): Xaa can be any naturally occurring amino acid
  misc_feature (254)..(254): Xaa can be any naturally occurring amino acid
  misc_feature (258)..(258): Xaa can be any naturally occurring amino acid
  misc_feature (262)..(263): Xaa can be any naturally occurring amino acid
  misc_feature (265)..(266): Xaa can be any naturally occurring amino acid
  misc_feature (272)..(272): Xaa can be any naturally occurring amino acid
  misc_feature (277)..(278): Xaa can be any naturally occurring amino acid
  misc_feature (284)..(284): Xaa can be any naturally occurring amino acid
EDLMFELSMWRCNDELRVRAEELHRSSKKDAKHYIEFWKQIPPNEPYRVILGGVRDKLYNTRERARQLLANGTSDILEETTFTNVEQFLEPLELCYRSLCACGDRSIADGSLLDFLRQVSTFGLSLVRLDIRQESDRHTDVMDAITKHLEIGSYREWSEERRQEWLLSELSGKRPLFGHDLPKTEEIADVLDTXHXISXLXSXSFGAYIISMATSPSDVLAVELLQRECHVKQPLXVVPLFEKLAXLESAPAAXARFXLDWXXTXXMESRSXDRYSXXGKDAGX

SEQ ID NO: 325 - DNA, 693 bp, Trifolium repens
  misc_feature (17)..(17): n is a, c, g, or t
  misc_feature (573)..(573): n is a, c, g, or t
  misc_feature (592)..(593): n is a, c, g, or t
  misc_feature (639)..(639): n is a, c, g, or t
  misc_feature (641)..(641): n is a, c, g, or t
  misc_feature (644)..(644): n is a, c, g, or t
  misc_feature (654)..(656): n is a, c, g, or t
  misc_feature (663)..(663): n is a, c, g, or t
  misc_feature (669)..(669): n is a, c, g, or t
  misc_feature (675)..(675): n is a, c, g, or t
  misc_feature (679)..(679): n is a, c, g, or t
  misc_feature (685)..(686): n is a, c, g, or t
  misc_feature (691)..(693): n is a, c, g, or t
gttcactgtctctctgnccaattttcctcccttgtcttctttttcttcttcttcctcgtatcttactgcctcattacacgggtgagaaggagtgaattgctccaatggcaacaaacaaaatggaaaaaatggcatcaattgatgcacagcttagacaattagtaccagcaaaagttagtgaagatgataaacttattgagtatgatgctttgttgttggatcggtttcttgatatccttcaggatttacatggagaggatctgaaagattctgttcaagaagtgtatgaactttctgcggagtatgaaagaaagcatgatcctaagaaacttgaagagctcggaaatttgataacaagtttagatgcaggagattcaattgttgttgctaagtccttttcgcacatgcttaacttggccaacttagctgaagaggttcagattgctcatcgtcgaaggaacaagttgaagaaaggagattttagggatgagagcaatgcaactaccgaatcagacatcgaagaaactcttaagagacttgtgtttaatatgaagaaatctcctcaggaagttnttgatgcgttgaagaaccnnaccgttgatttggttcttactgctcatcccactcagtccgttcgangnccnctgcttcccnnngcctggnacgggnaccgcnctgnctatcnnactgnnn

SEQ ID NO: 326 - protein, 196 aa, Trifolium repens
  misc_feature (157)..(157): Xaa can be any naturally occurring amino acid
  misc_feature (163)..(163): Xaa can be any naturally occurring amino acid
  misc_feature (179)..(180): Xaa can be any naturally occurring amino acid
  misc_feature (184)..(184): Xaa can be any naturally occurring amino acid
  misc_feature (187)..(187): Xaa can be any naturally occurring amino acid
  misc_feature (189)..(189): Xaa can be any naturally occurring amino acid
  misc_feature (191)..(192): Xaa can be any naturally occurring amino acid
  misc_feature (194)..(194): Xaa can be any naturally occurring amino acid
  misc_feature (196)..(196): Xaa can be any naturally occurring amino acid
MATNKMEKMASIDAQLRQLVPAKVSEDDKLIEYDALLLDRFLDILQDLHGEDLKDSVQEVYELSAEYERKHDPKKLEELGNLITSLDAGDSIVVAKSFSHMLNLANLAEEVQIAHRRRNKLKKGDFRDESNATTESDIEETLKRLVFNMKKSPQEVXDALKNXTVDLVLTAHPTQSVRXXLLPXAWXGXRXXYXTX

SEQ ID NO: 327 - DNA, 1307 bp, Trifolium repens
  misc_feature (2)..(4): n is a, c, g, or t
  misc_feature (6)..(6): n is a, c, g, or t
  misc_feature (8)..(8): n is a, c, g, or t
  misc_feature (23)..(23): n is a, c, g, or t
  misc_feature (33)..(33): n is a, c, g, or t
  misc_feature (988)..(988): n is a, c, g, or t
  misc_feature (1307)..(1307): n is a, c, g, or t
gnnncncnaccattacattaatnacactttccnctttcgccttgttctttctcttctcaatataaagaccaattcaattcccaattcttttggatccgaaatcattcattctacgcgtcttctctcttctctgcgtttcaaaccctagttgttttgttgattgatctaaatggcgttctttcgaagcgtttctgcgctttcaaaactacgatctcgtgtgggtcaacaacctagtcttgctaattcagttagatggctccaaactccaagctccagtaacactgatctttattctgagatgaaggagctagttccagagtatcaggaacgtgttaagaagttgaagaaagaccatggaagtgttgaattgggaaaaatcacagctgatatggtacttggtggaatgagaggaatgactgctttagtgtggctaggctcagctgttgacccagatgagggaattcgctttaggggcatgacaattcctgactgccagaaaacacttccaggtgcttttcctggtggggagcctttgcccgaggctatactgtggcttctattgaccggaaaggtaccaagtaaagagcaagtagattcattagctcacgaattgcgaagtcgtgcaaaaatcccagagtatgcttacaaggcaattgatgcactgcctgtttctgctcatccaatgacacaatttagtactggtgtaatggccctccaggtggagagtgagtttacaaaggcatacgagagtgggatacataagtcaaggtattgggagccaacttatgaggatagcttgaatttaattgctcgtttgcctggaattgctgcctatatttatcgacggatatacaaggatggaaaaatcataccattggatgattctttggattatggtgcaaactatgctcacatgttaggatttgatgatccagaaacgctggagtttatgaggctgtatatttctatccatagtgatcatgaaggnggcaacgttagttctcacacagctcacctagttgctagttcactatcagatccttatcttgcattcgcagctgctctgaatggtttagctggcccactgcatggtttagccaatcaggaagttctacgatggatcagaaacatagttaaggagtttggaactccaaacataagtacagaacaattgagcgactacattcataaaacattgaacagtggccaggttgtgcctggatatggacatggagttttgcgcaatacagacccaagatacacttgccagagggagtttgcattgaagcatttgcctaatgatccan

SEQ ID NO: 328 - protein, 378 aa, Trifolium repens
MAFFRSVSALSKLRSRVGQQPSLANSVRWLQTPSSSNTDLYSEMKELVPEYQERVKKLKKDHGSVELGKITADMVLGGMRGMTALVWLGSAVDPDEGIRFRGMTIPDCQKTLPGAFPGGEPLPEAILWLLLTGKVPSKEQVDSLAHELRSRAKIPEYAYKAIDALPVSAHPMTQFSTGVMALQVESEFTKAYESGIHKSRYWEPTYEDSLNLIARLPGIAAYIYRRIYKDGKIIPLDDSLDYGANYAHMLGFDDPETLEFMRLYISIHSDHEGNVSSHTAHLVASSLSDPYLAFAAALNGLAGPLHGLANQEVLRWIRNIVKEFGTPNISTEQLSDYIHKTLNSGQVVPGYGHGVLRNTDPRYTCQREFALKHLPNDP

SEQ ID NO: 329 - DNA, 692 bp, Trifolium repens
  misc_feature (2)..(4): n is a, c, g, or t
  misc_feature (6)..(6): n is a, c, g, or t
  misc_feature (8)..(8): n is a, c, g, or t
  misc_feature (33)..(33): n is a, c, g, or t
  misc_feature (692)..(692): n is a, c, g, or t
gnnncncnaccattacgttaattacattttctnctttcgccttgttctttctcttctcaatataaagaccaattcaattcccaattcttttggatccgaaatcattcattctacgcttcttctctcttctctgcgtttcaaaccctagttgttttgttgattgatcttaatggcgttctttcgaagcgtttctgcgctttcaaaactacgatctcgtgtgggtcaacaacctagtcttgctaattcagttagatggctccaaactccaagctccagtaacactgatctttattctgagatgaaggagctagttccagagtatcaggaacgtgttaagaagttgaagaaagaccatggaagtgttgaattgggaaaaatcacagctgatatggtacttggtggaatgagaggaatgactgctttagtgtggctaggctcagctgttgacccagatgagggaattcgctttaggggcatgacaattcctgactgccagaaaacacttccaggtgcttttcctggtggggagcctttgcccgaggctatactgtggcttctattgaccggaaaggtaccaagtaaagagcaagtagattcattagctcacgaattgcgaagtcgtgcaaaaatcccagagtatgcttacaaggcaattgatgcactgcctgtttctgctcatccaatgacacaan

SEQ ID NO: 330 - DNA, 588 bp, Trifolium repens
  misc_feature (9)..(9): n is a, c, g, or t
  misc_feature (12)..(12): n is a, c, g, or t
  misc_feature (588)..(588): n is a, c, g, or t
acattcgtnatncttttctctttcgccttgttctttctcttctaatataaagaccattcaattcccaattcttttggatccgaaatcattcattctacgcttcttctctcttctctgcgtttcaaaccctagttgttttgttgattgatcttaatggcgttctttcgaagcgtttctgcgctttcaaaactacgatctcgtgtgggtcaacaacctagtcttgctaattcagttagatggctccaaactccaagctccagtaacactgatctttattctgagatgaaggagctagttccagagtatcaggaacgtgttaagaagttgaagaaagaccatggaagtgttgaattgggaaaaatcacagctgatatggtacttggtggaatgagaggaatgactgctttagtgtggctaggctcagctgttgacccagatgagggaattcgctttaggggcatgacaattcctgactgccagaaaacacttccaggtgcttttcctggtggggagcctttgcccgaggctatactgtggcttctattgaccggaaaggtaccaagtaaagagcaagtagattcattagcn

SEQ ID NO: 331 - DNA, 681 bp, Trifolium repens
  misc_feature (6)..(6): n is a, c, g, or t
  misc_feature (13)..(13): n is a, c, g, or t
  misc_feature (17)..(17): n is a, c, g, or t
  misc_feature (26)..(26): n is a, c, g, or t
  misc_feature (32)..(32): n is a, c, g, or t
  misc_feature (35)..(35): n is a, c, g, or t
  misc_feature (38)..(38): n is a, c, g, or t
  misc_feature (45)..(45): n is a, c, g, or t
  misc_feature (681)..(681): n is a, c, g, or t
taccgnaaacttncttnctacttttncaaccnctncgncttcttncttctctgcgtttcaaaccctagttgttttgttgattgatctaaatggcgttctttcgaagcgtttctgcgctttcaaaactacgatctcgtgtgggtcaacaacctagtctcgctaattcagttagatggctccaaactccaagctccagtaacactgatctttattctgagatgaaggagctagttccagagtatcaggaacgtgttaagaagttgaagaaagatcatggaagtgttgaattgggaaaagtcacagctgatatggtacttggtggaatgagaggaatgacagctttagtgtggctaggctcagctgttgacccagatgagggaattcgctttaggggcatgacaattcctgactgccagaaaacacttccaggtgcttttcctggtggggagcctttgcccgaggctatactgtggctgccattgaccggaaaggtaccaagtaaagagcaagtagattcattagctcacgaattgcgaagtcgtgcaaaaatcccagagtatgcttacaaggcaattgatgcactgcctgtttctgctcatccaatgacacaatttagtactggtgtaatggccctccaggtggagagtgagtttacaaaggcatatgagagtgggatacatn

SEQ ID NO: 332 - DNA, 456 bp, Trifolium repens
  misc_feature (3)..(3): n is a, c, g, or t
  misc_feature (12)..(13): n is a, c, g, or t
  misc_feature (29)..(29): n is a, c, g, or t
  misc_feature (42)..(42): n is a, c, g, or t
  misc_feature (339)..(339): n is a, c, g, or t
  misc_feature (405)..(405): n is a, c, g, or t
  misc_feature (417)..(417): n is a, c, g, or t
  misc_feature (423)..(423): n is a, c, g, or t
  misc_feature (426)..(426): n is a, c, g, or t
  misc_feature (441)..(441): n is a, c, g, or t
  misc_feature (444)..(444): n is a, c, g, or t
  misc_feature (455)..(456): n is a, c, g, or t
gtncccgaaatnnttcctttctacttttnaccctgttgtttngttgattgatctaaatggcgttctttcgaagcgtttctgcgctttcaaaactacgatctcgtgtgggtcaacaacctagtcttgctaattcagttagatggctccaaactccaagctccagtaacactgatctttattctgagatgaaggagctagttccagagtatcaggaacgtgttaagaagttgaagaaagaccatggaagtgttgaattgggaaaaatcacagctgatatggtacttggtggaatgagaggaatgactgctttagtgtggctaggctcagctgttgacccanatgagggaattcgctttaggggcatgacaattcctgactgccacaaaacacttgcaggtgcttttnctggcggggagnctttgnccnaggctatactgcggnttntattgaccggnn

SEQ ID NO: 333 - DNA, 601 bp, Trifolium repens
  misc_feature (2)..(2): n is a, c, g, or t
  misc_feature (601)..(601): n is a, c, g, or t
gnggaaaaatacagctgatatggtacttggtggaatgagaggaatgactgctttagtgtggctaggctcagctgttgacccagatgagggaattcgctttaggggcatgacaattcctgactgccagaaaacacttccaggtgctcttcctggtggggagcctttgcccgaggctatactgtggcttctattgaccggaaaggtaccaagtaaagagcaagtagattcattagctcacgaattgcgaagtcgtgcaaaaatcccagagtatgcttacaaggcaattgatgcactgcctgtttctgctcatccaatgacacaatttagtactggtgtaatggccctccaggtggagagtgagtttacaaaggcatacgagagtgggatacataagtcaaggtattgggagccaacttatgaggatagcttgaatttaattgctcgtttgcctggaattgctgcctatatttatcgacggatatacaaggatggaaaaatcataccattggatgattctttggattatggtgcaaactatgctcacatgttaggatttgatgatccagaaacgctggagtttatgaggctgtatatttctatn

SEQ ID NO: 334 - DNA, 581 bp, Trifolium repens
  misc_feature (2)..(2): n is a, c, g, or t
  misc_feature (33)..(33): n is a, c, g, or t
  misc_feature (581)..(581): n is a, c, g, or t
gnagaggaatgactgctttagtgtggctggctngctgttgacccagatgagggaattcgctttaggggcatgacaattcctgactgccagaaacacttccaggtgcttttcctggtggggagcctttgcccgaggctatactgtggcttctattgaccggaaaggtaccaagtaaagagcaagtagattcattagctcacgaattgcgaagtcgtgcaaaaatcccagagtatgcttacaaggcaattgatgcactgcctgtttctgctcatccaatgacacaatttagtactggtgtaatggccctccaggtggagagtgagtttacaaaggcatacgagagtgggatacataagtcaaggtattgggagccaacttatgaggatagcttgaatttaattgctcgtttgcctggaattgctgcctatatttatcgacggatatacaaggatggaaaaatcataccattggatgattctttggattatggtgcaaactatgctcacatgttaggatttgatgatccagaaacgctggagtttatgaggctgtatatttctatccatagtgatcatgaaggn

SEQ ID NO: 335 - DNA, 559 bp, Trifolium repens
  misc_feature (2)..(2): n is a, c, g, or t
  misc_feature (14)..(14): n is a, c, g, or t
  misc_feature (16)..(16): n is a, c, g, or t
  misc_feature (559)..(559): n is a, c, g, or t
cntcagagtgggancntagtaaggattgggagccacttatgaggatgcttgaatttaattgctcgtttgcctggaattgctgcctatatttatcgacggatatacaaggatggaaaaatcataccattggatgattctttggattatggtgcaaactatgctcacatgttaggatttgatgatccagaaacgctggagtttatgaggctgtatatttctatccatagtgatcatgaaggtggcaacgttagttctcacacagctcacctagttgctagttcactatcagatccttatcttgcattcgcagctgctctgaatggtttagctggcccactgcatggtttagccaatcaggaagttctacgatggatcagaaacatagttaaggagtttggaactccaaacataagtacagaacaattgagcgactacattcataaaacattgaacagtggccaggttgtgcctggatatggacatggagttttgcgcaatacagacccaagatacacttgccagagggagtttgcattgaagcatttgcctaatgatccan

SEQ ID NO: 336 - DNA, 1244 bp, Trifolium repens
  misc_feature (2)..(2): n is a, c, g, or t
  misc_feature (7)..(7): n is a, c, g, or t
  misc_feature (124)..(124): n is a, c, g, or t
  misc_feature (1243)..(1244): n is a, c, g, or t
cntttcntttccacagcatcctaatcctaatcctaatcctaatcctattactaattactaattactaattactagtactaattagtaataccgatccctttttctcgaacccattcattcaagnagaagaaggaaaaacaaaatccacacaaacaaacatcttacaacaatgtcaacgacaactactacaaccgacgaatccaagctgcacgacgctgcacggaaccgtttggccaccctctcagctcacttgcttccttcctccacaacctccgccgcgctcctccatcctattcacctttcttcttcctccgggatctccccaccgtctaatgtcaaaggaacactcaccgttgttgatgaacgtaccgggaagaagtataccattgaggtctctcctgatggcaccgttaaagccaatgatttcaagaagatatcaactgggaagaatgataagggactcaaactttatgatcctggatatttaaacactgctcctgtgcgatcaacaatttcttatattgatggtgatgagggaatccttagatatagaggataccccattgaggagttggccgagaaaagcacctttccggaagtggcatatctcatattgtatggaaatttgccttctgcaaatcagttacaagaatgggaatttgctatatctcagcattcagccttacctcaaggagttttggatctcatacaatcaatgcctcaagatgcacatcctatgggcgtcctagtgaatgcaataagcgctctgtctgtttttcatcctgacgcaaatcctgctctcagaggtcttgacatctacaactcaaagcaagtgagagacaaacaaatagcacggattattggaaagataacaacaattgctgctgcaattaatcttagaatggcaggaaggccacctgtgcttccatccaacaaactatcttacacagagaacttcctatacatgcttgattctctaggcaatcggtcatataaacccaaccctcagctaactcgtgcactagacatcatcttcatcctgcatgcagaacatgaaatgaattgctctacatctgctgtacgacaccttgcatcaagcggcgtcgatgtatacactgctattgctggaggtgttggagctctgtatggacctcttcatggtggagctaatgaggcggtccttaaaatgctgagtgaaattggaagtgtcgataacattccagagttcattgaaggtgttaann

SEQ ID NO: 337 - protein, 358 aa, Trifolium repens
  misc_feature (358)..(358): Xaa can be any naturally occurring amino acid
MSTTTTTTDESKLHDAARNRLATLSAHLLPSSTTSAALLHPIHLSSSSGISPPSNVKGTLTVVDERTGKKYTIEVSPDGTVKANDFKKISTGKNDKGLKLYDPGYLNTAPVRSTISYIDGDEGILRYRGYPIEELAEKSTFPEVAYLILYGNLPSANQLQEWEFAISQHSALPQGVLDLIQSMPQDAHPMGVLVNAISALSVFHPDANPALRGLDIYNSKQVRDKQIARIIGKITTIAAAINLRMAGRPPVLPSNKLSYTENFLYMLDSLGNRSYKPNPQLTRALDIIFILHAEHEMNCSTSAVRHLASSGVDVYTAIAGGVGALYGPLHGGANEAVLKMLSEIGSVDNIPEFIEGVX

SEQ ID NO: 338 - DNA, 609 bp, Trifolium repens
  misc_feature (2)..(2): n is a, c, g, or t
  misc_feature (7)..(7): n is a, c, g, or t
  misc_feature (609)..(609): n is a, c, g, or t
cntttcntttccacagcatcctaatcctaatcctaatcctaatcctattactaattactaattactaattactagtactaattagtaataccgatccctttttctcgaacccattcattcaattcaaagaaggaaaaacaaaatcacacaaacaaacatcttacaacaatgtcaacgacaactactacaaccgacgaatccaagctgcacgacgctgcacggaaccgtttggctaccctctcagctcacttgcttccttcctccacaaactccgctgcgcttctccatcctatccacctttcttcttcctctgggatctccccaccgtctaatgtcaaaggaacactcaccgttgttgatgaacgtaccgggaagaagtataccattgaggtctctcctgatggcaccgttaaagccaatgatttcaagaagatatcaactgggaagaatgataaggggctcaaactttatgatcctggatatttaaacactgctcctgtgcgatcaacaatttcttatattgatggtgatgagggaatccttagatatagaggataccccattgaagagttggccgagaaaagcacctttccggaagtggcatatctn

SEQ ID NO: 339 - DNA, 589 bp, Trifolium repens
  misc_feature (2)..(2): n is a, c, g, or t
  misc_feature (5)..(5): n is a, c, g, or t
  misc_feature (16)..(16): n is a, c, g, or t
  misc_feature (589)..(589): n is a, c, g, or t
gnagnagaaggaaacncaaatccacaaacaaaactcttacaacaatgtcaaccacaactactacaaccgacgaatccaagctgcacgacgctgcacggaaccgtttggccaccctctcagctcacttgcttccttcctccacaacctccgccgcgctcctccatcctattcacctttccgcttcctccgggatctccccaccgtctaatgtcaaaggaacactcaccgttgttgatgaacgtaccgggaagaagtataacattgaggtctcacctgatggcaccgttaaagccaatgatttcaagaagatatcaactgggaagaatgataagggactcaaactttatgatcctggatatttaaacactgctcctgtgcgatcaacaatttcttatattgatggtgatgagggaatccttagatatagaggataccccattgaggagttggccgagaaaagcacctttccggaagtggcatatctcatattgtatggaaatttgccttctgcaaatcagttacaagaatgggaatttgctatatctcagcattcagccttacctcaaggagttttggatctcatacaatn

SEQ ID NO: 340 - DNA, 594 bp, Trifolium repens
  misc_feature (2)..(3): n is a, c, g, or t
  misc_feature (5)..(5): n is a, c, g, or t
  misc_feature (23)..(23): n is a, c, g, or t
  misc_feature (593)..(594): n is a, c, g, or t
gnngnagaaggaaacacaaaatncacaaacaaaaacatcttacaacaatgtcaaccacaactactacaaccgacgaatccaagctgcacgacgctgcacggaaccgtttggccaccctctcagctcacttgcttccttcctccacaacctccgccgcgctcctccatcctattcacctttccgcttcctccgggatctccccaccgtctaatgtcaaaggaacactcaccgttgttgatgaacgtaccgggaagaagtataacattgaggtctcacctgatggcaccgttaaagccaatgatttcaagaagatatcaactgggaagaatgataagggactcaaactttatgatcctggatatttaaacactgctcctgtgcgatcaacaatttcttatattgatggtgatgagggaatccttagatatagaggataccccattgaggagttggccgagaaaagcacctttccggaagtggcatatctcatattgtatggaaatttgccttctgcaaatcagttacaagaatgggaatttgctatatctcagcattcagccttacctcaaggagttttggatctcatacaatcnn

SEQ ID NO: 341 - DNA, 570 bp, Trifolium repens
  misc_feature (2)..(2): n is a, c, g, or t
  misc_feature (20)..(20): n is a, c, g, or t
  misc_feature (570)..(570): n is a, c, g, or t
gnaaagaggaaaaacaaatncacaaacaacatcttacacaatgtcacgacaactactacaaccgacgaatccaagctgcacgacgctgcacggaaccgtttagccaccctctcagctcacttgcttccttcctccacaacctccgccgcgctcctccatcctattcacctttcttcttcctccgggatctccccaccgtctaatgtcaaaggaacactcaccgttgttgatgaacgtaccgggaagaagtataccattgaggtctctcctgatggcaccgttaaagccaatgatttcaagaagatatcgactgggaagaatgataagggactcaaactttatgatcctggatatttaaacactgctcctgtgcgatcaacaatttcttatattgatggtgatgagggaatccttagatatagaggataccccattgaggagttggccgagaaaagcacctttccggaagtggcatatctcatattgtatggaaatttgccttctgcaaatcagttacaagaatgggaatttgctatatctcagcattcagccttacctcaaggagttttn

SEQ ID NO: 342 - DNA, 592 bp, Trifolium repens
  misc_feature (2)..(2): n is a, c, g, or t
  misc_feature (17)..(17): n is a, c, g, or t
  misc_feature (591)..(592): n is a, c, g, or t
gnaaggaaaaacaaatnccaaacaactcttacacaatgtcacgacaactactacaaccgacgaatccaagctgcacgacgctgcacggaaccgtttggctaccctctcagctcacttgcttccttcctccacaaactccgctgcgcttctccatcctatccacctttcttcttcctctgggatctccccaccgtctaatgtcaaaggaacactcaccgttgttgatgaacgtaccgggaagaagtataccattgaggtctctcctgatggcaccgttaaagccaatgatttcaagaagatatcaactgggaagaatgataaggggctcaaactttatgatcctggatatttaaacactgctcctgtgcgatcaacaatttcttatattgatggtgatgagggaatccttagatatagaggataccccattgaagagttggccgagaaaagcacctttccggaagtggcatatctcatattgtatggaaatttgccttctgcaaatcagttacaagaatgggaatttgctatatctcagcattcagccttacctcaaggagttttggatctcatacaatcaatgcctcaagnn

SEQ ID NO: 343 - DNA, 579 bp, Trifolium repens
  misc_feature (12)..(12): n is a, c, g, or t
  misc_feature (579)..(579): n is a, c, g, or t
atagaggctccnattgaggagttggcgagaaaagcacttttatggaagtgtcctatctataatgtatggaagtttacctactgaaagtaagttagctgaatggaatttcgctatatctcagcattcagctgttccagaaggagttttggatatcatacaatcaatgcctcatgatgcacatcctatgggtgtcctagtgaatgcaataagcgctctttctgtttttcatcctgacgccaatcctgctcttagaggtcttgatatttacgactcaaaggaagtgagagacaaacaaatagcacggattattggaaagattataacaattgctgctgcagtttatcttagaatggcaggaaggccacctgtgcttccatccaaccaactatcttacactgagaacttcctatacatgcttgattctttaggcaatcggtcatataaacccaaccctcagctaactcgtgcactagacattatcttcatcctgcatgcagaacatgaaatgaattgctctacatctgctgtccgacaccttgcatcaagcggcgttgatgtatatactgctattgctggggn

SEQ ID NO: 344 - DNA, 594 bp, Trifolium repens
  misc_feature (593)..(594): n is a, c, g, or t
agaatgggaatttgctatatctagcattagccttacctcaaggagttttggatctcatacaatcaatgcctcaagatgcacatcctatgggcgtgcttgttaatgctctaagtgctttgtctgtttttcatcctgatgcaaatcctgctctcagaggtcttgacatctacaactcaaagcaagtgagagacaaacaaatagtgcggattattggaaagataacaacaattgctgctgcgattaatcttagattgggaggaaggccacctgttcttccatccaacaaactttcttacacagagaacttcctttacatgcttgattctcttggcaatcggtcatataaacctaatcctcgtctaactcgtgcactggacatcatcttcatccttcatgcagaacatgaaatgaattgctctacatctgctgtacgccaccttgcatcaagtggtgtcgatgtatacactgctattgctggaggtgttggagctctgtatggacctcttcatggtggagctaatgaggcggtccttaaaatgctgagtgaaattggaagtgtcgataacattccagagttcattgaaggtgttaann

SEQ ID NO: 345 - DNA, 1738 bp, Trifolium repens
ggccgcgaattcactagtgattaagcagtggtaacaacgcagagtacgcgggggtaggcggagatttcaaacccaattttcctcttaaatctctcccaacttctccttccaattcccattaccattcattcccagaggtcgagatggcagcatcagcagcagctacttttactattggaactgcccaaacagggaggccacttcctcaatcaaacccttttggtttgaaagtcaattcccaggttaattttaagaccttctctggtctcaaggccatgtcatctctaagatgcgagtctgaatcatctttctttggcaacgaaactagtgctgctctgcgtgcaacttttgcacccaaagctcaaaaggaaaaccaaaacatcaaccgcaatttgcatcctcaggcatcctacaaagtggcggttcttggtgctgcaggaggaattggtcagccactggcacttctcattaagatgtcgcctttggtttccgacctgcatctttatgatatcgcgaatgttaagggagttgctgctgatatcagtcattgcaacactccttcaaaggttttggatttcacaggtgcttctgagttggcaaattgtttgaaaggtgtggatgtagttgttatacctgctggtgttcccagaaaacctggcatgactcgtgatgaccttttcaacatcaatgccggtatagtcagggacttggtcaccgctgttgcagataattgccctggtgcttttattcatgttatcagtaacccggtgaactctacagttcctattgctgctgaaattctgaaacaaaagggtgtttatgatcctaaaaagctctttggtgttactacacttgatgttgtgagggcaaacacatttgttgctcagaaaaagaacctgaggctgattgatgtagatgttcctgttgttggtggtcatgccgggattaccattcttcctcttctgtcaaagacaagaccctcagcaaatttcactgatgaagaaattgaggcgctaactgtcaggattcaaaatgctggaactgaagttgttgaggccaaggctggtgcagggtctgctactttgtcaatggcctatgcagcagctagatttgttgaatcatctcttcgtgcgcttgacggtgacgctgatgtgtatgagtgctcatttgtacagtcagatctgactgaccttccgttttttgcttcaagggtgaagattggtaggaaaggagtcgaggctttgattccaactgatctccaagggttgagtgagtatgagcagaaggctttggaagcacttaaaccagaacttaaggctagcattgaaaagggtattgcttttgctcaaaagcaaactgtttctgcttaacttattttgtgaaagcatatattctatactctctagcgtccatgcgagagaatgtcaatgggtgatttcttgggttatggatttatttgagcatgaatactacttagaggacttagattgcagatttatgtagcatcatttactgcttccagaacttatgatttaaattttccatagtatcatttctacttacagatttgttagtagaacgggaggggcttccatttctattctctatattgagctttagttttgatcagaaatctcaatagattgttactatcatgtactactagaattggaaaaatgtaaacgttgcattttgaataatactgcctttggactagtttgtgtttcgaaaaaaaaaa

SEQ ID NO: 346 - protein, 408 aa, Trifolium repens
MAASAAATFTIGTAQTGRPLPQSNPFGLKVNSQVNFKTFSGLKAMSSLRCESESSFFGNETSAALRATFAPKAQKENQNINRNLHPQASYKVAVLGAAGGIGQPLALLIKMSPLVSDLHLYDIANVKGVAADISHCNTPSKVLDFTGASELANCLKGVDVVVIPAGVPRKPGMTRDDLFNINAGIVRDLVTAVADNCPGAFIHVISNPVNSTVPIAAEILKQKGVYDPKKLFGVTTLDVVRANTFVAQKKNLRLIDVDVPVVGGHAGITILPLLSKTRPSANFTDEEIEALTVRIQNAGTEVVEAKAGAGSATLSMAYAAARFVESSLRALDGDADVYECSFVQSDLTDLPFFASRVKIGRKGVEALIPTDLQGLSEYEQKALEALKPELKASIEKGIAFAQKQTVSA

SEQ ID NO: 347 - DNA, 3372 bp, Trifolium repens
gaattcgattaagcagtggtaacaacgcagagtacgcggggataacactgtctctctgatccaaattttccatcccttgtcttctttttcttcttcttcctcgtatcttactgcctcattacacgggtgagaaggagtgaattgctccaatggcaacaaacaaaatggaaaaaatggcatcaattgatgcacagcttagacaattagtaccagcaaaagttagtgaagatgataaacttattgagtatgatgctttgttgttggatcggtttcttgatatccttcaggatttacatggagaggatctgaaagattctgttcaagaagtgtatgaactttctgcggagtatgaaagaaagcatgatcctaagaaacttgaagagctcggaaatttgataacaagtttagatgcaggagattcaattgttgttgctaagtccttttcgcacatgcttaacttggccaacttagctgaagaggttcagattgctcatcgtcgaaggaacaagttgaagaaaggagattttagggatgagagcaatgcaactaccgaatcagacatcgaagaaactcttaagagacttgtgtttaatatgaagaaatctcctcaggaagtttttgatgcgttgaagaaccagaccgttgatttggttcttactgctcatcctactcagtcggttcgtaggtcgttgcttcaaaagcatggaagggtaaggaactgtttatctcaattgtatgctaaagacatcactcctgatgataagcaagagctcgacgaagctctccagagggagattcaagctgcattccgtaccgatgaaatcaagaggacacctccaacaccacaagatgagatgagagcagggatgagttacttccacgaaacaatttggaagggtgtccctaaatttcttcgccgtgttgatactgcgttgaagaacatagggattaacgaacgtgttccctataatgctcctcttattcagttttcttcatggatggggggtgatcgtgatggtaatccgagagtgactcctgaagtaacgagagatgtttgcttactagctagaatgatggctgcaaatttgtattattcccagattgaagatcttatgtttgaactgtctatgtggcgttgcaatgatgagctgcgtgatcgcgcagaagaacttcacaggaattccaagaaagatgaagttgcaaaacactacatagagttttggaaaaaaattcctttgaatgaaccgtaccgtgttatacttggtgatgtaagggacaagctctatcgtactcgtgagcggtctcgctatctcttagctcatggctattctgaaattcctgaggaagccacattcaccaatgttgatgagttcttggaacctcttgaactatgctacagatcactctgtgcttgtggtgatcgtgcggttgccgatggaagccttcttgatttcttgaggcaagtttccacttttggactgtcactggtaagacttgatataaggcaggagtcagatcgtcacacggacgtgatggatgccattaccaaacatttggaaattggatcctaccaagattggtctgaagaaaaacgacaggaatggcttttgtctgagttggttggcaaaaggccgctttttggacctgatctacctcaaaccgatgaaattagagaagttttagagacatttcatgtcatagcagaacttccatcagacaactttggagcctatatcatttcgatggcaactgccccgtctgatgtgctggcggttgaacttcttcaacgtgaatgcaaaatcaagaatccgttaagagttgttccattgtttgagaaacttgctgatctcgagtctgctcctgctgctttggctcggttgttttcgatagactggtacataaaccgtatcgatgggaagcaagaagttatgattggatattctgattcaggtaaagatgctggaaggttttctgccgcatggcagctatataaggctcaggaggacctcataaatgttgctcagaaatacggtgttaagctaacaatgttccatggtcgtggtggaactgttggaagaggaggtggacctactcatcttgctatcttgtctcaaccaccagacacaattcacggatctcttcgtgtgacggttcaaggtgaagttattgaacagtcgttcggagaggagcacttgtgctttagaacgctgcagcgtttcactgctgccactctagaacacggaatgcgtcccccaagttctccaaaaccggaatggcgtgaattgatggatcagatggctgtcattgctaccgaggagtaccgttcaattgtgttcaaggaaccacgttttgttgagtatttccgtctggccacaccagagatggagtacggaaggatgaacattggaagtcgaccggcaaaaagaaggccatgtggaggcattgaaacactgcgtgcgataccatggatttttgcatggacacagacaaggtttcatcttccagtatggcttggctttggagcagcttttaaacaagttattgcgaaggatgttaagaatcttcatatgctgcaagagatgtacaatcaatggcctttctttagggtcactattgatttagtcgaaatggtgttcgctaagggtgaccctggtattgcagccctgaatgataggctactagtttctcaggatctttggccatttggggaacagttgagaagcaaatatgaagaaactaagaaactcctacttcaggtggcaacacacaaggaagttcttgaaggagatccctacttgaaacaaagactcagactccgtgattcttacattacaacccttaacgttttccaagcatacacattgaaacggatccgtgatccaaactataaggtggaggtgcgcccccgcgtatcgaaagaatctgctgaaacaagtaaatcggctgatgaacttgtaacattgaatccaacaagtgaatatgctcctggtttggaagacacactcattctcaccatgaagggtattgctgctggcatgcaaaacactggttaatttttggtgatttttttcacttgtatttgtttcttttatgttaagtgtgtgctaagatatcataaatactagatgaatctagttgcaagcacttcaagtgagtgcttttttttttctttttccttttcctttttcataagaaactcacatcaggttttgttgatgtttttccttactttgttaccatacaaacgagttaatgcaattgatgttatgtttcaatgcatagattttatctcctttcttctaaaaaaaaaaaaaaaaaaaaaaaaaaaaaagtactctgcgttgttaccactgcttaatcactagtgaattc

SEQ ID NO: 348 - protein, 967 aa, Trifolium repens
MATNKMEKMASIDAQLRQLVPAKVSEDDKLIEYDALLLDRFLDILQDLHGEDLKDSVQEVYELSAEYERKHDPKKLEELGNLITSLDAGDSIVVAKSFSHMLNLANLAEEVQIAHRRRNKLKKGDFRDESNATTESDIEETLKRLVFNMKKSPQEVFDALKNQTVDLVLTAHPTQSVRRSLLQKHGRVRNCLSQLYAKDITPDDKQELDEALQREIQAAFRTDEIKRTPPTPQDEMRAGMSYFHETIWKGVPKFLRRVDTALKNIGINERVPYNAPLIQFSSWMGGDRDGNPRVTPEVTRDVCLLARMMAANLYYSQIEDLMFELSMWRCNDELRDRAEELHRNSKKDEVAKHYIEFWKKIPLNEPYRVILGDVRDKLYRTRERSRYLLAHGYSEIPEEATFTNVDEFLEPLELCYRSLCACGDRAVADGSLLDFLRQVSTFGLSLVRLDIRQESDRHTDVMDAITKHLEIGSYQDWSEEKRQEWLLSELVGKRPLFGPDLPQTDEIREVLETFHVIAELPSDNFGAYIISMATAPSDVLAVELLQRECKIKNPLRVVPLFEKLADLESAPAALARLFSIDWYINRIDGKQEVMIGYSDSGKDAGRFSAAWQLYKAQEDLINVAQKYGVKLTMFHGRGGTVGRGGGPTHLAILSQPPDTIHGSLRVTVQGEVIEQSFGEEHLCFRTLQRFTAATLEHGMRPPSSPKPEWRELMDQMAVIATEEYRSIVFKEPRFVEYFRLATPEMEYGRMNIGSRPAKRRPCGGIETLRAIPWIFAWTQTRFHLPVWLGFGAAFKQVIAKDVKNLHMLQEMYNQWPFFRVTIDLVEMVFAKGDPGIAALNDRLLVSQDLWPFGEQLRSKYEETKKLLLQVATHKEVLEGDPYLKQRLRLRDSYITTLNVFQAYTLKRIRDPNYKVEVRPRVSKESAETSKSADELVTLNPTSEYAPGLEDTLILTMKGIAAGMQNTG

SEQ ID NO: 349 - DNA, 2066 bp, Trifolium repens
gaattcgattaagcagtggtaacaacgcagagtacgcggggagcacaacattacgttaattacattttctctttcgccattgttctttctcttctcaatataaagaccaattcaattcccaattcttttggatccgaaatcattcattctacgcttcttctctcttctctgcgtttcaaaccctagttgttttgttgattgatcttaatggcgttctttcgaagcgtttctgcgctttcaaaactacgatctcgtgtgggtcaacaacctagtcttgctaattcagttagatggctccaaactccaagctccagtaacactgatctttattctgagatgaaggagctagttccagagtatcaggaacgtgttaagaagttgaagaaagaccatggaagtgttgaattgggaaaaatcacagctgatatggtacttggtggaatgagaggaatgactgctttagtgtggctaggctcagctgttgacccagatgagggaattcgctttaggggcatgacaattcctgactgccagaaaacacttccaggtgcttttcctggtggggagcctttgcccgaggctatactgtggcttctattgaccggaaaggtaccaagtaaagagcaagtagattcattagctcacgaattgcgaagtcgtgcaaaaatcccagagtatgcttacaaggcaattgatgcactgcctgtttctgctcatccaatgacacaatttagtactggtgtaatggccctccaggtggagagtgagtttacaaaggcatacgagggtgggatacataagtcaaggtattgggagccaacttatgaggatagcttgaatttaattgctcgtttgcctggaattgctgcctatatttatcgacggatatacaaggatggaaaaatcataccattggatgattctttggattatggtgcaaactatgctcacatgttaggatttgatgatccagaaacgctggagtttatgaggctgtatatttctatccatagtgatcatgaaggtggcaacgttagttctcacacagctcacctagttgctagttcactatcagatccttatcttgcattcgcagctgctctgaatggtttagctggcccactgcatggtttagccaatcaggaagttctacgatggatcagaaacatagttaaggagtttggaactccaaacataagtacagaacaattgagcgactacattcataaaacattgaacagtggccaggttgtgcctggatatggacatggagttttgcgcaatacagacccaagatacacttgccagagggagtttgcattgaagcatttgcctaatgatccacttttccagctggtgtccaaaattaaagaagtcgtgcctcccattctgaccaagttaggaaaggttaaaaatccatggcctaatgttgatgctcatagtggagtactactaaactactatggtctaactgaagaaaactattataccgttctttttggtgtcgcgaggagtattggagttggccctcagctgatatgggaccgtgctcttggaatgccacttgaaaggccaaaaagtgtcacactggagaaacttgagaaactggtcggcgcatcgtcctaaaattgaaagcgcggttatctgtggattactaaaatacactctgcggttgtaggttgttggtaactctaaacatttggtgcaattgcaatgagaaatattttgcccaaatcccccttcccttatttttctggttgttttgtcagcattttttgattgaggagattttggtatttaggaaaagggtgggattatcaccctcacagttgtctttccatttttctacacagcataaattaggtcccaagggagcatcagaataaaggcattatgttttgggggtaatccctctgtattctttctaaataggattgacccctttgacaaaaaatacaaattatcaatatcactcgtctacttgaagattcgactaaaaaaaaaaaaaaaaaaaaaaaaaaaaaagtactctgcgttgttaccactgcttaatcactagtgaattc

SEQ ID NO: 350 - protein, 472 aa, Trifolium repens
MAFFRSVSALSKLRSRVGQQPSLANSVRWLQTPSSSNTDLYSEMKELVPEYQERVKKLKKDHGSVELGKITADMVLGGMRGMTALVWLGSAVDPDEGIRFRGMTIPDCQKTLPGAFPGGEPLPEAILWLLLTGKVPSKEQVDSLAHELRSRAKIPEYAYKAIDALPVSAHPMTQFSTGVMALQVESEFTKAYEGGIHKSRYWEPTYEDSLNLIARLPGIAAYIYRRIYKDGKIIPLDDSLDYGANYAHMLGFDDPETLEFMRLYISIHSDHEGGNVSSHTAHLVASSLSDPYLAFAAALNGLAGPLHGLANQEVLRWIRNIVKEFGTPNISTEQLSDYIHKTLNSGQVVPGYGHGVLRNTDPRYTCQREFALKHLPNDPLFQLVSKIKEVVPPILTKLGKVKNPWPNVDAHSGVLLNYYGLTEENYYTVLFGVARSIGVGPQLIWDRALGMPLERPKSVTLEKLEKLVGASS

SEQ ID NO: 351 - DNA, 2066 bp, Trifolium repens; identical to SEQ ID NO: 349

SEQ ID NO: 352 - protein, 472 aa, Trifolium repens; identical to SEQ ID NO: 350

SEQ ID NO: 353 - DNA, 1885 bp, Trifolium repens
gaattcgattaagcagtggtaacaacgcagagtacgcggggatccgaaatcattcattctacttttcaacctgttgttttgttgattgatctaaatggcgttctttcgaagcgtttctgcgctttcaaaactacgatctcgtgtgggtcaacaacctagtcttgctaattcagttagatggctccaaactccaagctccagtaacactgatctttattctgagatgaaggagctagttccagagtatcaggaacgtgttaagaagttgaagaaagaccatggaagtgttgaattgggaaaaatcacagctgatatggtacttggtggaatgagaggaatgactgctttagtgtggctaggctcagctgttgacccagatgagggaattcgctttaggggcatgacaattcctgactgccagaaaacacttccaggtgcttttcctggtggggagcctttgcccgaggctatactgtggcttctattgaccggaaaggtaccaagtaaagagcaagtagattcattagctcacgaattgcgaagtcgtgcaaaaatcccagagtatgcttacaaggcaattgatgcactgcctgtttctgctcatccaatgacacaatttagtactggtgtaatggccctccaggtggagagtgagtttacaaaggcatacgagagtgggatacataagtcaaggtattgggagccaacttatgaggatagcttgaatttaattgctcgtttgcctggaattgctgcctatatttatcgacggatatacaaggatggaaaaatcataccattggatgattctttggattatggtgcaaactatgctcacatgttaggatttgatgatccagaaacgctggagtttatgaggctgtatatttctatccatagtgatcatgaaggtggcaacgttagttctcacacagctcacctagttgctagttcactatcagatccttatcttgcattcgcagctgctctgaatggtttagctggcccactgcatggtttagccaatcaggaagttctacgatggatcagaaacatagttacggaatttggaactccaaacataagtacagaacaattgagcgactacattcataaaacattgaacagtggccaggttgtgcctggatatggacatggagttttgcgcaatacagacccaagatacacttgccagagggagtttgcattgaagcatttgcctaatgatccacttttccagctggtgtccaaaattaaagaagtcgtgcctcccattctgaccaagttaggaaaggttaaaaatccatggcctaatgttgatgctcatagtggagtactactaaactactatggtctaactgaagaaaactattataccgttctttttggcgtcgcgaggagtattggagttggccctcagctgatatgggaccgtgctcttggaatgccacttgaaaggccaaaaagtgtcacactggagaaacttgagaaactcgtcggtgcatcatcctaaaattgaaagcacagttacctctggattactaaaatacacactgcggttgtaggttgttggtaactcgaaacatttggtgcaattgcaatgagaaatattcgttgcccacatccccttcccttatttttctggttgttttgtcagcattttttgattgagaagattttggtatttaggaaagggtgggattatcaccctcacagttgtctttccatttttctacacagcataaattaggtcccaagggagcatcagaataaaggcattatgttttgggggtaatccccctgtattctttctaaaaaaaaaaaaaaaaaaaaaaaaaaaaaaagtactctgcgttgttaccactgcttaatcactagtgaattc

SEQ ID NO: 354 - protein, 472 aa, Trifolium repens
MAFFRSVSALSKLRSRVGQQPSLANSVRWLQTPSSSNTDLYSEMKELVPEYQERVKKLKKDHGSVELGKITADMVLGGMRGMTALVWLGSAVDPDEGIRFRGMTIPDCQKTLPGAFPGGEPLPEAILWLLLTGKVPSKEQVDSLAHELRSRAKIPEYAYKAIDALPVSAHPMTQFSTGVMALQVESEFTKAYESGIHKSRYWEPTYEDSLNLIARLPGIAAYIYRRIYKDGKIIPLDDSLDYGANYAHMLGFDDPETLEFMRLYISIHSDHEGGNVSSHTAHLVASSLSDPYLAFAAALNGLAGPLHGLANQEVLRWIRNIVTEFGTPNISTEQLSDYIHKTLNSGQVVPGYGHGVLRNTDPRYTCQREFALKHLPNDPLFQLVSKIKEVVPPILTKLGKVKNPWPNVDAHSGVLLNYYGLTEENYYTVLFGVARSIGVGPQLIWDRALGMPLERPKSVTLEKLEKLVGASS

SEQ ID NO: 355 - DNA, 22 bp, Artificial
  Primer sequence
ttgcccgaggctatactgtggc

SEQ ID NO: 356 - DNA, 19 bp, Artificial
  Primer sequence
cagctcacctagttgctag

SEQ ID NO: 357 - DNA, 20 bp, Artificial
  Primer sequence
ccatggcctaatgttgatgc

SEQ ID NO: 358 - DNA, 22 bp, Artificial
  Primer sequence
ttggcctttcaagtggcattcc

SEQ ID NO: 359 - DNA, 21 bp, Artificial
  Primer sequence
cagaatgggaggcacgacttc

SEQ ID NO: 360 - DNA, 20 bp, Artificial
  Primer sequence
atgtgagcatagtttgcacc

SEQ ID NO: 361 - DNA, 23 bp, Artificial
  Primer sequence
gactgccagaaaacacttccagg

SEQ ID NO: 362 - DNA, 18 bp, Artificial
  Primer sequence
atgactgctttagtgtgg

SEQ ID NO: 363 - DNA, 23 bp, Artificial
  Primer sequence
ctcaagtttctccagtgtgacac

SEQ ID NO: 364 - DNA, 18 bp, Artificial
  Primer sequence
tgacttatgtatcccacc

SEQ ID NO: 365 - DNA, 20 bp, Artificial
  Primer sequence
gctctgaatggtttagctgg

SEQ ID NO: 366 - DNA, 23 bp, Artificial
  Primer sequence
gcactgcctgtttctgctcatcc

SEQ ID NO: 367 - DNA, 20 bp, Artificial
  Primer sequence
agccaacttatgaggatagc

SEQ ID NO: 368 - DNA, 22 bp, Artificial
  Primer sequence
ctccaatactcctcgcgacgcc

SEQ ID NO: 369 - DNA, 19 bp, Artificial
  Primer sequence
aggcacaacctggccactg

SEQ ID NO: 370 - DNA, 20 bp, Artificial
  Primer sequence
acgttgccaccttcatgatc

SEQ ID NO: 371 - DNA, 21 bp, Artificial
  Primer sequence
gttgttatacctgctggtgtt

SEQ ID NO: 372 - DNA, 20 bp, Artificial
  Primer sequence
ctcactcaacccttggagat

SEQ ID NO: 373 - DNA, 24 bp, Artificial
  Primer sequence
tcctaagaaacttgaagagctcgg

SEQ ID NO: 374 - DNA, 18 bp, Artificial
  Primer sequence
agatgtttgcttactagc

SEQ ID NO: 375 - DNA, 23 bp, Artificial
  Primer sequence
gccagcagcaatacccttcatgg

SEQ ID NO: 376 - DNA, 18 bp, Artificial
  Primer sequence
ttgcttctcaactgttcc

SEQ ID NO: 377 - DNA, 51 bp, Artificial
  Primer sequence
ggggacaagtttgtacaaaaaagcaggcttgatcttaatggcgttctttcg

SEQ ID NO: 378 - DNA, 50 bp, Artificial
  Primer sequence
ggggaccactttgtacaagaaagctgggttttcaattttaggacgatgcg

SEQ ID NO: 379 - DNA, 50 bp, Artificial
  Primer sequence
ggggacaagtttgtacaaaaaagcaggctttgttgattgatcttaatggc

SEQ ID NO: 380 - DNA, 49 bp, Artificial
  Primer sequence
ggggaccactttgtacaagaaagctgggttagtaatccacagataaccg

SEQ ID NO: 381 - DNA, 55 bp, Artificial
  Primer sequence
ggggacaagtttgtacaaaaaagcaggctctagattgttgattgatctaaatggc

SEQ ID NO: 382 - DNA, 56 bp, Artificial
  Primer sequence
ggggaccactttgtacaagaaagctgggtctagattcaattttaggatgatgcacc

SEQ ID NO: 383 - DNA, 56 bp, Artificial
  Primer sequence
ggggacaagtttgtacaaaaaagcaggctctagaaattcccattaccattcattcc

SEQ ID NO: 384 - DNA, 57 bp, Artificial
  Primer sequence
ggggaccactttgtacaagaaagctgggtctagattgacattctctcgcatggacgc

SEQ ID NO: 385 - DNA, 50 bp, Artificial
  Primer sequence
ggggacaagtttgtacaaaaaagcaggcttgagaaggagtgaattgctcc

SEQ ID NO: 386 - DNA, 53 bp, Artificial
  Primer sequence
ggggaccactttgtacaagaaagctgggtatgatatcttagcacacacttaac

SEQ ID NO: 387 - DNA, 36 bp, Artificial
  Primer sequence
ataataaccggttgatcatgagcggagaattaaggg

SEQ ID NO: 388 - DNA, 36 bp, Artificial
  Primer sequence
ataatagcggccgctagtaacatagatgacaccgcg

SEQ ID NO: 389 - DNA, 32 bp, Artificial
  Primer sequence
aatagcggccgcgatttagtactggattttgg

SEQ ID NO: 390 - DNA, 31 bp, Artificial
  Primer sequence
aataaccggtacccacgaaggagcatcgtgg

SEQ ID NO: 391 - DNA, 32 bp, Artificial
  Primer sequence
ataataaccggtgcccggggatctcctttgcc

SEQ ID NO: 392 - DNA, 36 bp, Artificial
  Primer sequence
ataatagcggccgcatgcatgttgtcaatcaattgg

SEQ ID NO: 393 - DNA, 34 bp, Artificial
  Primer sequence
taataccggtaaatttattatgrgtttttttccg

SEQ ID NO: 394 - DNA, 37 bp, Artificial
  Primer sequence
taatgcggccgctaagggcagcccatacaaatgaagc

SEQ ID NO: 395 - DNA, 24 bp, Artificial
  Primer sequence
ccgattccgtttcaatggctcgta

SEQ ID NO: 396 - DNA, 23 bp, Artificial
  Primer sequence
gccatccttaaccctaagcacgt

SEQ ID NO: 397 - DNA, 23 bp, Artificial
  Primer sequence
ttgcatttgcttggaacaactag

SEQ ID NO: 398 - DNA, 21 bp, Artificial
  Primer sequence
gcaagagcaaacatgaaacca

SEQ ID NO: 399 - DNA, 19 bp, Artificial
  Primer sequence
atgggtcttggtggttgca

SEQ ID NO: 400 - DNA, 25 bp, Artificial
  Primer sequence
gcagcaagaagatcaaccaaagcca

The invention claimed is:

1. A substantially purified or isolated nucleic acid encoding a malate dehydrogenase (MDH) polypeptide from a clover (*Trifolium*) species, wherein said nucleic acid is from white clover (*Trifolium repens*).

2. A substantially purified or isolated nucleic acid comprising a nucleotide sequence selected from the group consisting of
   (a) SEQ ID NOS 205, 218, 252, 271, 276, 288, 293, 297, 302, 306, and 308;
   (b) full length complements of the sequences recited in (a);
   (c) full length sequences antisense to the sequences recited in (a) or (b);
   (d) functionally active variants having at least approximately 95% identity to an entire sequence recited in (a), wherein said functionally active variant encodes a polypeptide having malate dehydrogenase activity in a plant;
   (e) functionally active variants having at least 95% identity to an entire sequence recited in (b) or (c), wherein said variant modifies the expression of a polynucleotide of (a); and
   (f) RNA sequences corresponding to an entire sequence recited in (a), (b), (c), (d), or (e).

3. A construct including a nucleic acid comprising a nucleotide sequence selected from the group consisting of
   (a) a sequence encoding a malate dehydrogenase (MDH) polypeptide selected from the group consisting of SEQ ID NOS 205, 218, 252, 271, 276, 288, 293, 297, 302, 306, and 308;
   (b) full length complements of the sequences recited in (a);
   (c) full length sequences antisense to the sequences recited in (a) or (b);
   (d) functionally active variants having at least approximately 95% identity to an entire sequence recited in (a), wherein said functionally active variant encodes a polypeptide having malate dehydrogenase activity in a plant;
   (e) functionally active variants having at least 95% identity to an entire sequence recited in (b) or (c), wherein said variant modifies the expression of a polynucleotide of (a); and
   (f) RNA sequences corresponding to an entire sequence recited in (a), (b), (c), (d), or (e).

4. The construct according to claim 3 wherein the nucleic acid is operably linked to one or more regulatory elements, such that the nucleic acid is expressed.

5. The construct according to claim 4, wherein the one or more regulatory elements include a promoter and a terminator, said promoter, nucleic acid and terminator being operably linked.

6. A plant cell, plant, plant seed or other plant part, including the construct according to claim 3.

7. A method of modifying one or more plant functions selected from the group consisting of organic acid synthesis; organic acid secretion; nutrient acquisition; aluminium and acid soil tolerance; and nitrogen fixation and nodule function; in a plant, said method including introducing into said plant an effective amount of a nucleic acid according to claim 1.

8. The method according to claim 7 wherein said nucleic acid comprises a sequence selected from the group consisting of SEQ ID NOS 205, 218, 252, 271, 276, 288, 293, 297, 302, 306, and 308.

9. The method according to claim 7 wherein the method is modifying nutrient acquisition and the nutrient is phosphorous.

10. A substantially purified or isolated nucleic acid wherein the nucleic acid is a single nucleotide polymorphism (SNP) from a nucleic acid according to claim 1.

11. The construct according to claim 3, wherein the nucleic acid comprises a sequence selected from the group consisting of SEQ ID NOS 205, 218, 252, 271, 276, 288, 293, 297, 302, 306, and 308.

12. A plant cell, plant, plant seed or other plant part, comprising the construct including a nucleic acid or according to claim 11.

13. The nucleic acid according to claim 2, comprising Seq. ID No. 271.

14. The construct according to claim 3, comprising Seq. ID No. 271.

15. The construct according to claim 4, comprising Seq. ID No. 271.

16. A plant cell comprising the construct according to claim 15.

17. The construct of claim 3, further comprising one or more nucleic acids selected from the group consisting of:
   (a) nucleic acids encoding citrate synthase (CS) polypeptide; and
   (b) nucleic acids encoding a phosphoenolpyruvate carboxylase (PEPC) polypeptide,
   wherein the nucleic acids are from a clover (*Trifolium*), medic (*Medicago*), ryegrass (*Lolium*) or fescue (*Festuca*) species.

18. The construct according to claim 17, wherein the construct comprises a nucleic acid encoding an MDH polypeptide selected from the group consisting of SEQ ID NOS 205, 218, 252, 271, 276, 288, 293, 297, 302, 306, and 308.

19. The construct according to claim 17, wherein the construct comprises a nucleic acid encoding a PEPC polypeptide.

20. The construct according to claim 19, wherein the construct comprises a nucleic acid encoding an MDH polypeptide is selected from the group consisting of SEQ ID NOS 205, 218, 252, 271, 276, 288, 293, 297, 302, 306, and 308.

21. The construct according to claim 19, wherein the construct comprises a nucleic acid encoding a CS polypeptide.

22. The construct according to claim 21, wherein the construct comprises a nucleic acid encoding an MDH polypeptide selected from the group consisting of SEQ ID NOS 205, 218, 252, 271, 276, 288, 293, 297, 302, 306, and 308.

23. A plant cell, plant, plant seed or other plant part, comprising the construct in accordance with claim 17.

* * * * *

UNITED STATES PATENT AND TRADEMARK OFFICE
CERTIFICATE OF CORRECTION

| | | |
|---|---|---|
| PATENT NO. | : 8,017,370 B2 | Page 1 of 1 |
| APPLICATION NO. | : 10/553507 | |
| DATED | : September 13, 2011 | |
| INVENTOR(S) | : Spangenberg et al. | |

It is certified that error appears in the above-identified patent and that said Letters Patent is hereby corrected as shown below:

Column 30, Claim 20, Lines 62-65 should read as follows: -- The construct according to claim 19, wherein the construct comprises a nucleic acid encoding an MDH polypeptide selected from the group consisting of SEQ ID NOS 205, 218, 252, 271, 276, 288, 293, 297, 302, 306, and 308. --

Signed and Sealed this
Twenty-fifth Day of October, 2011

David J. Kappos
*Director of the United States Patent and Trademark Office*